US010801039B2

(12) United States Patent
Palmarini et al.

(10) Patent No.: US 10,801,039 B2
(45) Date of Patent: Oct. 13, 2020

(54) REASSORTANT BTV AND AHSV VACCINES

(71) Applicants: Boehringer Ingelheim Animal Health USA Inc., Duluth, GA (US); The University Court of The University of Glasgow, Glasgow (GB)

(72) Inventors: Massimo Palmarini, Strathblane (GB); Sandro Filipe Nunes, Glasgow (GB); Pascal Hudelet, Tramole (FR); Jean Christophe Audonnet, Lyons (FR)

(73) Assignees: THE UNIVERSITY COURT OF THE UNIVERSITY OF GLASGOW, Glasgow (GB); Boehringer Ingelheim Animal Health USA Inc., Duluth, GA (US)

( * ) Notice: Subject to any disclaimer, the term of this patent is extended or adjusted under 35 U.S.C. 154(b) by 0 days.

(21) Appl. No.: 13/917,259

(22) Filed: Jun. 13, 2013

(65) Prior Publication Data

US 2013/0337010 A1     Dec. 19, 2013

Related U.S. Application Data

(60) Provisional application No. 61/659,198, filed on Jun. 13, 2012.

(51) Int. Cl.
| | | |
|---|---|---|
| *C12N 15/86* | (2006.01) | |
| *A61K 39/12* | (2006.01) | |
| *A61K 39/00* | (2006.01) | |

(52) U.S. Cl.
CPC ............. *C12N 15/86* (2013.01); *A61K 39/12* (2013.01); *A61K 2039/5252* (2013.01); *A61K 2039/552* (2013.01); *A61K 2039/55505* (2013.01); *A61K 2039/55577* (2013.01); *C12N 2720/12121* (2013.01); *C12N 2720/12134* (2013.01); *C12N 2720/12171* (2013.01)

(58) Field of Classification Search
None
See application file for complete search history.

(56) References Cited

FOREIGN PATENT DOCUMENTS

WO    WO2009068870    6/2009

OTHER PUBLICATIONS

Anderson G. A., J. L. Stott, et al. (1985). "Subclinical and clinical bluetongue disease in cattle: clinical, pathological and pathogenic considerations." *Prog Clin Biol Res* 178: 103-7.
Andrew, M., P. Whiteley, et al. (1995). "Antigen specificity of the ovine cytotoxic T lymphocyte response to bluetongue virus." *Vet Immunol Immunopathol* 47(3-4): 311-22.
Athmaram, T. N., G. Bali, et al. (2007). "Heterologous expression of Bluetongue VP2 viral protein fragment in Pichia pastoris." *Virus genes* 35(2): 265-271.
Bonneau, K. R., B. A. Mullens, et al. (2001). "Occurrence of genetic drift and founder effect during quasispecies evolution of the VP2 and NS3/NS3A genes of bluetongue virus upon passage between sheep, cattle, and Culicoides sonorensis." *J Virol* 75(17): 8298-305.

(Continued)

*Primary Examiner* — Michelle S Horning
(74) *Attorney, Agent, or Firm* — John Ezcurra; Suzanne Seavello Shope

(57) ABSTRACT

The present invention encompasses BTV and ASHV vaccines or compositions and methods of producing recombinant reassortant BTV and ASHV vectors and methods of vaccination against BTV and ASHV.

7 Claims, 30 Drawing Sheets

Specification includes a Sequence Listing.

A) Each combination of monoreassortant. In addition, BTV-1 or 8 cores were rescued with the outer capsid proteins VP2 and VP5 of the heterologous virus.

(56) References Cited

OTHER PUBLICATIONS

Boone, J. D., U. B. Balasuriya, et al. (2007). "Recombinant canarypox virus vaccine co-expressing genes encoding the VP2 and VP5 outer capsid proteins of bluetongue virus induces high level protection in sheep." Vaccine 25(4): 672-678.
Boyce, M., C. C. Celma, et al. (2008). "Development of reverse genetics systems for bluetongue virus: recovery of infectious virus from synthetic RNA transcripts." Journal of virology 82(17): 8339-8348.
Breard, E., G. Belbis, et al. (2011). "Evaluation of humoral response and protective efficacy of two inactivated vaccines against bluetongue virus after vaccination of goats." Vaccine 29(13): 2495-2502.
Calvo-Pinilla, E., T. Rodriguez-Calvo, et al. (2009). "Heterologous prime boost vaccination with DNA and recombinant modified vaccinia virus Ankara protects IFNAR(−/−) mice against lethal bluetongue infection." Vaccine 28(2): 437-445.
Capocefalo, A., V. Franceschi, et al. (2010). "Expression and secretion of Bluetongue virus serotype 8 (BTV-8)VP2 outer capsid protein by mammalian cells." Journal of virological methods 169(2): 420-424.
Cowley, J. A. and B. M. Gorman (1989). "Cross-neutralization of genetic reassortants of bluetongue virus serotypes 20 and 21." Veterinary microbiology 19(1): 37-51.
De Mattos, C. A., C. C. de Mattos, et al. (1994). "Heterogeneity of the L2 gene of field isolates of bluetongue virus serotype 17 from the San Joaquin Valley of California." Virus Res 31(1): 67-87.
DeMaula, C. D., K. R. Bonneau, et al. (2000). "Changes in the outer capsid proteins of bluetongue virus serotype ten that abrogate neutralization by monoclonal antibodies." Virus Res 67(1): 59-66.
Di Plessis M. et al. 1998,"Protein aggregation complicates the development of baculovirus-expressed African horsesickness virus serotype 5 VP2 subunit vaccines", Onderstepoort Journal of Veterinary Research 65: 321-329.
Eschbaumer, M., B. Hoffmann, et al. (2009). "Efficacy of three inactivated vaccines against bluetongue virus serotype 8 in sheep." Vaccine 27(31): 4169-4175.
Forzan, M., C. Wirblich, et al. (2004). "A capsid protein of nonenveloped Bluetongue virus exhibits membrane fusion activity." Proceedings of the National Academy of Sciences of the United States of America 101(7): 2100-2105.
Franceschi, V., A. Capocefalo, et al. (2011). "Immunization of knock-out alpha/beta interferon receptor mice against lethal bluetongue infection with a BoHV-4-based vector expressing BTV-8 VP2 antigen." Vaccine 29(16): 3074-3082.
Fukusho, A., G. D. Ritter, et al. (1987). "Variation in the bluetongue virus neutralization protein VP2." The Journal of general virology 68 ( Pt 11): 2967-2973.
Ghiasi, H., A. Fukusho, et al. (1987). "Identification and characterization of conserved and variable regions in the neutralization VP2 gene of bluetongue virus." Virology 160(1): 100-109.
Gould, A. R. and B. T. Eaton (1990). "The amino acid sequence of the outer coat protein VP2 of neutralizing monoclonal antibody-resistant, virulent and attenuated bluetongue viruses." Virus research 17(3): 161-172.
Grubman, M.J. & Lewis, S.A., Identification and characterization of the structural and nonstructural proteins of African horsesickness virus and determination of the genome coding assignments (1992). Virology 186, 444-451.
Hamers, C., S. Galleau, et al. (2009). "Use of inactivated bluetongue virus serotype 8 vaccine against virulent challenge in sheep and cattle." The Veterinary record 165(13): 369-373.
Hassan, S. S. and P. Roy (1999). "Expression and functional characterization of bluetongue virus VP2 protein: role in cell entry." J Virol 73(12): 9832-42.
Hofmann, M. A., S. Renzullo, et al. (2008). "Genetic characterization of toggenburg orbovirus, a new bluetongue virus, from goats, Switzerland." Emerging infectious diseases 14(12): 1855-1861.

Huismans, H. and B. J. Erasmus (1981). "Identification of the serotype-specific and group-specific antigens of bluetongue virus." Onderstepoort J Vet Res 48(2): 51-8.
Huismans, H., N. T. van der Walt, et al. (1987). "Isolation of a capsid protein of bluetongue virus that induces a protective immune response in sheep." Virology 157(1): 172-9.
Hund, A., N. Gollnick, et al. (2012). "A two year BTV-8 vaccination follow up: molecular diagnostics and assessment of humoral and cellular Immune reactions." Veterinary microbiology 154(3-4): 247-256.
Hwang, G. Y. and J. K. Li (1993). "Identification and localization of a serotypic neutralization determinant on the VP2 protein of bluetongue virus 13." Virology 195(2): 859-862.
Inumaru, S. and P. Roy (1987). "Production and characterization of the neutralization antigen VP2 of bluetongue virus serotype 10 using a baculovirus expression vector." Virology 157(2): 472-479.
Jewell, J. E. and J. O. Mecham (1994). "Identification of an amino acid on VP2 that affects neutralization of bluetongue virus serotype 10." Virus research 33(2): 139-144.
Lewis, S.A. and Grubman, M.J., VP2 is the major exposed protein on orbiviruses (1991). Archives of Virology 121, 233-236.
Lobato, Z. I., B. E. Coupar, et al. (1997). "Antibody responses and protective immunity to recombinant vaccinia virus-expressed bluetongue virus antigens." Vet Immunol Immunopathol 59(3-4): 293-309.
Lourenco, S. and P. Roy (2011). "In vitro reconstitution of Bluetongue virus infectious cores." Proceedings of the National Academy of Sciences of the United States of America 108(33): 13746-13751.
Maan, S., N. S. Maan, et al. (2007). "Analysis and phylogenetic comparisons of full-length VP2 genes of the 24 bluetongue virus serotypes." The Journal of general virology 88(Pt 2): 621-630.
Maan, S., N. S. Maan, et al. (2011). "Complete genome characterisation of a novel 26th bluetongue virus serotype from Kuwait." PloS one 6(10): e26147.
MacLachlan, N. J. (1994). "The pathogenesis and immunology of bluetongue virus infection of ruminants." Comp Immunol Microbiol Infect Dis 17(3-4): 197-206.
Matsuo, E., C. C. Celma, et al. (2011). "Generation of replication-defective virus-based vaccines that confer full protection in sheep against virulent bluetongue virus challenge." Journal of virology 85(19): 10213-10221.
Mertens, P. P., S. Pedley, et al. (1989). "Analysis of the roles of bluetongue virus outer capsid proteins VP2 and VP5 in determination of virus serotype." Virology 170(2): 561-565.
Minke, J.M., Audonnet, J.C., Fischer, L., Equine viral vaccines: the past, present and future (2004b). Veterinary Research 35: 425-443.
Minke, J.M., Siger, L., Karaca, K., Austgen, L., Gordy, P., Bowen, R., Renshaw, R.W., Loosmore, S., Audonnet, J.C., Nordgren, B., Recombinant canarypoxvirus vaccine carrying the prM/E genes of West Nile virus protects horses against a West Nile virus-mosquito challenge (2004a). Arch. Virol. Suppl. 221-230.
Minke, J.M., Toulemonde, C.E., Couple, H., Guigal, P.M., Dinic, S., Sindle, T., Jessett, D., Black, L., Bublot, M., Pardo, M.C., Audonnet, J.C., Efficacy of a canarypox-vectored recombinant vaccine expressing the hemagglutinin gene of equine influenza H3N3 virus in the protection of ponies from viral challenge (2007). American Journal of Veterinary Research 68: 213-219.
Palmarini M et al., PloS pathogens, 2011, 7(12): e1002477.
Pearson, L.D., Roy, P., Genetically engineered multi-component virus-like particles as veterinary vaccines (1993). Immunol.Cell Biol. 71 ( Pt 5), 381-389.
Perez de Diego, A. C., P. J. Sanchez-Cordon, et al. (2012). "Characterization of the immune response induced by a commercially available inactivated bluetongue virus serotype 1 vaccine in sheep." TheScientificWorldJournal 2012: 147158.
Perrin, A., E. Albina, et al. (2007). "Recombinant capripoxviruses expressing proteins of bluetongue virus: evaluation of immune responses and protection in small ruminants." Vaccine 25(37-38): 6774-6783.
Piet A van Rijn et al., Virology Journal, 2010, 7:261.
Poulet, H., Brunet, S., Boularand, C., Guiot, A.L., Leroy, V., Tartaglia, J., Minke, J., Audonnet, J.C., Desmettre, P., Efficacy of a canarypox virus-vectored vaccine against feline leukaemia (2003). Veterinary Record 153: 141-145.

(56) References Cited

OTHER PUBLICATIONS

Pritchard, L. I. and A. R. Gould (1995). "Phylogenetic comparison of the serotype-specific VP2 protein of bluetongue and related orbiviruses." Virus research 39(2-3): 207-220.
Roy et al., Journal of Viology, 2011, 85, 19;10213-10221.
Roy, P. (1996). "Orbivirus structure and assembly." *Virology* 216(1): 1-11.
Roy, P., T. Urakawa, et al. (1990). "Recombinant virus vaccine for bluetongue disease in sheep." *J Virol* 64(5): 1998-2003.
Scanlen, M., Paweska, J.T., Verschoor, J.A., Van Dijk, A.A., The protective efficacy of a recombinant VP2-based African horsesickness subunit vaccine candidate is determined by adjuvant (2002). *Vaccine* 20, 1079-1088.
Schwartz-Cornil, I., P. P. Mertens, et al. (2008). "Bluetongue virus: virology, pathogenesis and immunity." Veterinary research 39(5): 46.
Spreull, J. (1905). "Malarial catarrhal fever (bluetongue) of sheep in South Africa." *J. Comp. Path.. Ther.* 18: 321-337.
Stewart, M., C. I. Dovas, et al. (2012). "Protective efficacy of Bluetongue virus-like and subvirus-like particles in sheep: presence of the serotype-specific VP2, independent of its geographic lineage, is essential for protection." Vaccine 30(12): 2131-2139.

Van Gennip, R. G., D. Veldman, et al. (2010). "Genetic modification of Bluetongue virus by uptake of "synthetic" genome segments." Virology journal 7: 261.
Van Gennip, R. G., S. G. van de Water, et al. (2012). "Bluetongue viruses based on modified-live vaccine serotype 6 with exchanged outer shell proteins confer full protection in sheep against virulent BTV8." PloS one 7(9): e44619.
Van Gennip, R. G., S. G. van de Water, et al. (2012). "Rescue of recent virulent and avirulent field strains of bluetongue virus by reverse genetics." PloS one 7(2): e30540.
Verwoerd, D. W., H. J. Els, et al. (1972). "Structure of the bluetongue virus capsid." *J Virol* 10 (4) :783-94.
Wei, P., E. C. Sun, et al. (2013). "Identification of a novel bluetongue virus 1-specific B-cell epitope using a monoclonal antibody against the VP2 protein." Archives of virology 158(5): 1099-1104.
White, D. M., W. C. Wilson, et al. (2005). "Studies on overwintering of bluetongue viruses in insects." *J Gen Virol* 86(Pt 2): 453-62.
Wilson, W. C. and J. O. Mecham (2000) . "Molecular Evolution of Orbiviruses . " *Proc USAHA* 104: 169-180.
Zhang, X., M. Boyce, et al. (2010) . "Bluetongue virus coat protein VP2 contains sialic acid-binding domains, and VP5 resembles enveloped virus fusion proteins." Proceedings of the National Academy of Sciences of the United States of America 107(14): 6292-6297.

Figure 1A

A) Each combination of monoreassortant. In addition, BTV-1 or 8 cores were rescued with the outer capsid proteins VP2 and VP5 of the heterologous virus.

Figure 1B

B) An overview of the rescuse process. RNA is synthesised from a liniarised plasmid and transfected into BSR cells. Rescued viruses are picked and amplified in cell culture before confirming the genotype by RT-PCR and sequencing.

Growth curve analyses of reassortant viruses. Most reassortants grow similarly to the wild-type parental viruses.

VP2 is responsible for virus neutralisation.

A) BTV-1, BTV-1$_{8VP5}$ and BTV-8$_{1VP2}$ and BTV-8$_{1VP2,VP5}$ were all neutralised by BTV-1 antisera but not by BTV-8 antisera, whereas BTV-8, BTV-8$_{1VP5}$, BTV-1$_{8VP2}$ and BTV-1$_{8VP2,VP5}$ were all neutralised by BTV-8 antisera but not BTV-1 antisera.

B) A summary cartoon: BTV neutralisation correlates with VP2, regardless of the VP5 (for BTV-1:BTV-8 reassortants)

Figure 5

BTV reassortants were rescued with 9 segments from wild-type BTV-1 and containing the VP2 of either BTV-8 (B), BTV-2(C), BTV-4(D) or BTV-9(E).

Figure 6

10 plasmids coding for each BTV segment

↓ *transcription*

10 RNA

↓ *transfection*

↓ *replication*

Outer
VP2 & 5
Core
VP3&7&Enz
"Universal
Backbone"

BTV Synthetic Reassortant

Figure 7A

| SEQ ID NO | type | Serotype | Gene name | GenBank accession No. | strain |
|---|---|---|---|---|---|
| 1 | PRO | 1 | VP1 | ACR58458 (encoded by FJ969719) | Bluetongue virus serotype 1, South Africa Isolate |
| 2 | PRO | 1 | VP2 | ACR58459 (encoded by FJ969720) | Bluetongue virus serotype 1, South Africa Isolate |
| 3 | PRO | 1 | VP3 | ACR58460 (encoded by FJ969721) | Bluetongue virus serotype 1, South Africa Isolate |
| 4 | PRO | 1 | VP4 | ACR58461 (encoded by FJ969722) | Bluetongue virus serotype 1, South Africa Isolate |
| 5 | PRO | 1 | VP5 | ACR58462 (encoded by FJ969723) | Bluetongue virus serotype 1, South Africa Isolate |
| 6 | PRO | 1 | NS1 | ACR58463 (encoded by FJ969724) | Bluetongue virus serotype 1, South Africa Isolate |
| 7 | PRO | 1 | VP7 | ACR58464 (encoded by FJ969725) | Bluetongue virus serotype 1, South Africa Isolate |
| 8 | PRO | 1 | NS2 | ACR58465 (encoded by FJ969726) | Bluetongue virus serotype 1, South Africa Isolate |
| 9 | PRO | 1 | VP6/NS4 | AEU03964 (encoded by JN848767) | Bluetongue virus serotype 1, South Africa Isolate Sequence identical to Bluetongue virus 1 strain SZ97/1 |
| 10 | PRO | 1 | NS3/3a | ACR58467 (encoded by FJ969728) | Bluetongue virus serotype 1, South Africa Isolate |
| 11 | PRO | 8 | VP2 | None | BTV-8NT (NET2006/04) |
| 12 | PRO | 8 | VP5 | CAM57247 (encoded by AM498056) | BTV-8NT (NET2006/04) |
| 13 | PRO | 2 (Italy) | VP2 | AEO19855 (encoded by JN255863) | Bluetongue virus 2 strain BTV-2IT(L) segment 2 |

| | | Figure 7B | | | |
|---|---|---|---|---|---|
| 14 | PRO | 2 (Italy) | VP5 | AEO19851 (encoded by JN255867) | Bluetongue virus 2 strain BTV-2IT(L) segment 6 |
| 15 | PRO | 2 (South-Africa) | VP5 | CAE53012 (encoded by AJ586696) | Bluetongue virus 2 vp5 gene for outer capsid protein VP5, genomic RNA, isolate RSArrrr/02 |
| 16 | PRO | 3 | VP2 | CAE51090 (encoded by AJ585124) | Bluetongue virus 3 VP2 gene, isolate South Africa-ref, genomic RNA |
| 17 | PRO | 3 | VP5 | CAE53013 (encoded by AJ586697) | Bluetongue virus 3 vp5 gene for outer capsid protein VP5, genomic RNA, isolate RSArrrr/03 |
| 18 | PRO | 4 | VP2 | ABB71699 (encoded by DQ191280) | Bluetongue virus 4 isolate 10353 segment S2, complete sequence |
| 19 | PRO | 4 | VP5 | CAE53015 (encodecd by AJ586699) | Bluetongue virus 4 vp5 gene for outer capsid protein VP5, genomic RNA, isolate RSArrrr/04 |
| 20 | PRO | 5 | VP2 | CAE51092 (encoded by AJ585126) | Bluetongue virus 5 VP2 gene, isolate South Africa-ref, genomic RNA |
| 21 | PRO | 5 | VP5 | CAE53016 (encoded by AJ586700) | Bluetongue virus 5 vp5 gene for outer capsid protein VP5, genomic RNA, isolate RSArrrr/05 |
| 22 | PRO | 6 | VP2 | CAE51093 (encoded by AJ585127) | Bluetongue virus 6 VP2 gene, isolate South Africa-ref, genomic RNA |
| 23 | PRO | 6 | VP5 | CAE53019 (encoded by AJ586703) | Bluetongue virus 6 vp5 gene for outer capsid protein VP5, genomic RNA, isolate RSArrrr/06 |
| 24 | PRO | 7 | VP2 | CAE51094 (encoded by AJ585128) | Bluetongue virus 7 VP2 gene, isolate South Africa-ref, genomic RNA |
| 25 | PRO | 7 | VP5 | CAE53020 (encoded by AJ586704) | Bluetongue virus 7 vp5 gene for outer capsid protein VP5, genomic RNA, isolate RSArrrr/07 |
| 26 | PRO | 9 (South-Africa) | VP2 | AEO19747 (encoded by JN255953) | Bluetongue virus 9 strain BTV-9RSA(WT) segment 2, complete sequence |

| | | | | | Figure 7C |
|---|---|---|---|---|---|
| 27 | PRO | 9 (South-Africa) | VP5 | CAE53024 (encoded by AJ586708) | Bluetongue virus 9 vp5 gene for outer capsid protein VP5, genomic RNA, isolate RSArrrr/09 |
| 28 | PRO | 9 (Italy) | VP2 | AEO19795 (encoded by JN255913) | Bluetongue virus 9 strain BTV-9IT(H) segment 2 |
| 29 | PRO | 10 | VP2 | CAE51097 (encoded by AJ585131) | Bluetongue virus 10 VP2 gene, isolate South Africa-ref, genomic RNA |
| 30 | PRO | 10 | VP5 | CAE53025 (encoded by AJ586709) | Bluetongue virus 10 vp5 gene for outer capsid protein VP5, genomic RNA, isolate RSArrrr/10 |
| 31 | PRO | 11 | VP2 | CAE51098 (encoded by AJ585132) | Bluetongue virus 11 VP2 gene, isolate South Africa-ref, genomic RNA |
| 32 | PRO | 11 | VP5 | CAE53026( encoded by AJ586710) | Bluetongue virus 11 vp5 gene for outer capsid protein VP5, genomic RNA, isolate RSArrrr/11 |
| 33 | PRO | 12 | VP2 | CAE51099 (encoded by AJ585133) | Bluetongue virus 12 VP2 gene, isolate South Africa-ref, genomic RNA |
| 34 | PRO | 12 | VP5 | CAE53027 (encoded by AJ586711) | Bluetongue virus 12 vp5 gene for outer capsid protein VP5, genomic RNA, isolate RSArrrr/12 |
| 35 | PRO | 13 | VP2 | CAE51100 (encoded by AJ585134) | Bluetongue virus 13 VP2 gene, isolate South Africa-ref, genomic RNA |
| 36 | PRO | 13 | VP5 | AE53029 (encoded by AJ586713) | Bluetongue virus 13 vp5 gene for outer capsid protein VP5, genomic RNA, isolate RSArrrr/13 |
| 37 | PRO | 14 | VP2 | CAE51101 (encoded by AJ585135) | Bluetongue virus 14 VP2 gene, isolate South Africa-ref, genomic RNA |
| 38 | PRO | 14 | VP5 | CAE53030 (encoded by AJ586714) | Bluetongue virus 14 vp5 gene for outer capsid protein VP5, genomic RNA, isolate RSArrrr/14 |
| 39 | PRO | 15 | VP2 | CAE51102 (encoded by AJ585136) | Bluetongue virus 15 VP2 gene, isolate South Africa-ref, genomic RNA |
| 40 | PRO | 15 | VP5 | CAE53032( encoded by AJ586716) | Bluetongue virus 15 vp5 gene for outer capsid protein VP5, genomic RNA, isolate RSArrrr/15 |

| | | | | Figure 7D | |
|---|---|---|---|---|---|
| 41 | PRO | 16 | VP2 | CAE51103 (encoded by AJ585137) | Bluetongue virus 16 VP2 gene, isolate South Africa-ref, genomic RNA |
| 42 | PRO | 16 | VP5 | CAE53035 (encoded by AJ586719) | Bluetongue virus 16 vp5 gene for outer capsid protein VP5, genomic RNA, isolate RSArrrr/16 |
| 43 | PRO | 17 | VP2 | CAE51104 (encoded by AJ585138) | Bluetongue virus 17 VP2 gene, isolate South Africa-ref, genomic RNA |
| 44 | PRO | 17 | VP5 | CAE53036 (encoded by AJ586720) | Bluetongue virus 17 vp5 gene for outer capsid protein VP5, genomic RNA, isolate RSArrrr/17 |
| 45 | PRO | 18 | VP2 | CAE51105 (encoded by AJ585139) | Bluetongue virus 18 VP2 gene, isolate South Africa-ref, genomic RNA |
| 46 | PRO | 18 | VP5 | CAE53037 (encoded by AJ586721) | Bluetongue virus 18 vp5 gene for outer capsid protein VP5, genomic RNA, isolate RSArrrr/18 |
| 47 | PRO | 19 | VP2 | CAE51106 (encoded by AJ585140) | Bluetongue virus 19 VP2 gene, isolate South Africa-ref, genomic RNA |
| 48 | PRO | 19 | VP5 | CAE53038 (encoded by AJ586722) | Bluetongue virus 19 vp5 gene for outer capsid protein VP5, genomic RNA, isolate RSArrrr/19 |
| 49 | PRO | 20 | VP2 | CAE51107 (encoded by AJ585141) | Bluetongue virus 20 VP2 gene, isolate South Africa-ref, genomic RNA |
| 50 | PRO | 20 | VP5 | CAE53039 (encoded by AJ586723) | Bluetongue virus 20 vp5 gene for outer capsid protein VP5, genomic RNA, isolate RSArrrr/20 |
| 51 | PRO | 21 | VP2 | CAE51108 (encoded by AJ585142) | Bluetongue virus 21 VP2 gene, isolate South Africa-ref, genomic RNA |
| 52 | PRO | 21 | VP5 | CAE53040 (encoded by AJ586724) | Bluetongue virus 21 vp5 gene for outer capsid protein VP5, genomic RNA, isolate RSArrrr/21 |
| 53 | PRO | 22 | VP2 | CAE51109 (encoded by AJ585143) | Bluetongue virus 22 VP2 gene, isolate South Africa-ref, genomic RNA |

| | | | | Figure 7E | |
|---|---|---|---|---|---|
| 54 | PRO | 22 | VP5 | CAE53041 (encoded by AJ586725) | Bluetongue virus 22 vp5 gene for outer capsid protein VP5, genomic RNA, isolate RSArrrr/22 |
| 55 | PRO | 23 | VP2 | CAE51110 (encoded by AJ585144) | Bluetongue virus 23 VP2 gene, isolate South Africa-ref, genomic RNA |
| 56 | PRO | 23 | VP5 | CAE53043 (encoded by AJ586727) | Bluetongue virus 23 vp5 gene for outer capsid protein VP5, genomic RNA, isolate RSArrrr/23 |
| 57 | PRO | 24 | VP2 | CAE51111 (encoded by AJ585145) | Bluetongue virus 24 VP2 gene, isolate South Africa-ref, genomic RNA |
| 58 | PRO | 24 | VP5 | CAE53046 (encoded by AJ586730) | Bluetongue virus 24 vp5 gene for outer capsid protein VP5, genomic RNA, isolate RSArrrr/24 |
| 59 | PRO | 25 | VP2 | ACJ06702 (encoded by EU839840) | Bluetongue virus isolate TOV segment 2 VP2 gene, complete cds |
| 60 | PRO | 25 | VP5 | ACJ06704 (encoded by EU839842) | Bluetongue virus isolate TOV segment 6 VP5 gene, complete cds |
| 61 | PRO | 26 | VP2 | AED99447 (encoded by HM590642) | Bluetongue virus isolate KUW2010/02 segment 2 outer capsid protein VP2 gene, complete cds |
| 62 | PRO | 26 | VP5 | AER60536 (encoded by JN255159) | Bluetongue virus isolate KUW2010/02 segment 6, complete sequence |
| 63 | DNA | 1 | VP1 | FJ969719 | Bluetongue virus serotype 1, South Africa Isolate |
| 64 | DNA | 1 | VP2 | FJ969720 | Bluetongue virus serotype 1, South Africa Isolate |
| 65 | DNA | 1 | VP3 | FJ969721 | Bluetongue virus serotype 1, South Africa Isolate |
| 66 | DNA | 1 | VP4 | FJ969722 | Bluetongue virus serotype 1, South Africa Isolate |
| 67 | DNA | 1 | VP5 | FJ969723 | Bluetongue virus serotype 1, South Africa Isolate |
| 68 | DNA | 1 | NS1 | FJ969724 | Bluetongue virus serotype 1, South Africa Isolate |

| Figure 7F ||||||
|---|---|---|---|---|---|
| 69 | DNA | 1 | VP7 | FJ969725 | Bluetongue virus serotype 1, South Africa Isolate |
| 70 | DNA | 1 | NS2 | FJ969726 | Bluetongue virus serotype 1, South Africa Isolate |
| 71 | DNA | 1 | VP6/NS4 | JN848767 | Bluetongue virus serotype 1, South Africa Isolate Sequence identical to Bluetongue virus 1 strain SZ97/1 |
| 72 | DNA | 1 | NS3/3a | FJ969728 | Bluetongue virus serotype 1, South Africa Isolate |
| 73 | DNA | 8 | VP2 | None | BTV-8NT (NET2006/04) |
| 74 | DNA | 8 | VP5 | AM498056 | BTV-8NT (NET2006/04) |
| 75 | DNA | 1 | VP2 | FJ969720 | BTV1-VP2 used in making sBTV, encoding ACR58459.1 |
| 76 | DNA | 1 | VP5 | FJ969723 | BTV1-VP5 used in making sBTV encoding ACR58462.1 |
| 77 | DNA | 2 | VP2 | JN255863 | BTV2-VP2 used in making sBTV encoding AEO19855.1 |
| 78 | DNA | 2 | VP5 | JN255867 | BTV2-VP5 used in making sBTV encoding AEO19851.1 |
| 79 | DNA | 2 | VP2 | AJ585123 | BTV2-VP2 used in making sBTV encoding CAE51089.1 |
| 80 | DNA | 2 | VP5 | JN255867 | BTV2-VP5 used in making sBTV encoding AEO19851.1 |
| 81 | DNA | 3 | VP2 | AJ585124 | BTV3-VP2 used in making sBTV encoding CAE51090.1 |
| 82 | DNA | 3 | VP5 | AJ586697 | BTV3-VP5 used in making sBTV encoding CAE53013.1 |
| 83 | DNA | 4 | VP2 | DQ191280 | BTV4-VP2 used in making sBTV encoding ABB71699.1 |
| 84 | DNA | 4 | VP5 | AJ586699 | BTV4-VP5 used in making sBTV encoding CAE53015.1 |
| 85 | DNA | 4 | VP2 | AJ585125 | BTV4-VP2 used in making sBTV encoding CAE51091.1 |
| 86 | DNA | 4 | VP5 | AJ586699 | BTV4-VP5 used in making sBTV encoding CAE53015.1 |
| 87 | DNA | 5 | VP2 | AJ585126 | BTV2-VP2 used in making sBTV encoding CAE51092.1 |
| 88 | DNA | 5 | VP5 | AJ586700 | BTV5-VP5 used in making sBTV encoding CAE53016.1 |

| Figure 7G ||||||
|---|---|---|---|---|---|
| 89 | DNA | 6 | VP2 | AJ585127 | BTV6-VP2 used in making sBTV encoding CAE51093.1 |
| 90 | DNA | 6 | VP5 | AJ586703 | BTV6-VP5 used in making sBTV encoding CAE53019.1 |
| 91 | DNA | 7 | VP2 | AJ585128 | BTV7-VP2 used in making sBTV encoding CAE51094.1 |
| 92 | DNA | 7 | VP5 | AJ586704 | BTV7-VP5 used in making sBTV encoding CAE53020.1 |
| 93 | DNA | 8 | VP2 | AM498052 | BTV8-VP2 used in making sBTV encoding CAM57243.2 |
| 94 | DNA | 8 | VP5 | AM498056 | BTV8-VP5 used in making sBTV encoding CAM57247.2 |
| 95 | DNA | 9 | VP2 | JN255903 | BTV9-VP2 used in making sBTV encoding AEO19807.1 |
| 96 | DNA | 9 | VP5 | AJ586708 | BTV9-VP5 used in making sBTV encoding CAE53024.1 |
| 97 | DNA | 9 | VP2 | AJ585130 | BTV9-VP2 used in making sBTV encoding CAE51096.1 |
| 98 | DNA | 9 | VP5 | AJ586708 | BTV9-VP5 used in making sBTV encoding CAE53024.1 |
| 99 | DNA | 10 | VP2 | AJ585131 | BTV10-VP2 used in making sBTV encoding CAE51097.1 |
| 100 | DNA | 10 | VP5 | AJ586709 | BTV10-VP5 used in making sBTV encoding CAE53025.1 |
| 101 | DNA | 11 | VP2 | AJ585132 | BTV11-VP2 used in making sBTV encoding CAE51098.1 |
| 102 | DNA | 11 | VP5 | AJ586710 | BTV11-VP5 used in making sBTV encoding CAE53026.1 |
| 103 | DNA | 12 | VP2 | AJ585133 | BTV12-VP2 used in making sBTV encoding CAE51099.1 |
| 104 | DNA | 12 | VP5 | AJ586711 | BTV12-VP5 used in making sBTV encoding CAE53027.1 |
| 105 | DNA | 13 | VP2 | AJ585134 | BTV13-VP2 used in making sBTV encoding CAE51100.1 |
| 106 | DNA | 13 | VP5 | AJ586713 | BTV13-VP5 used in making sBTV encoding CAE53029.1 |
| 107 | DNA | 14 | VP2 | AJ585135 | BTV14-VP2 used in making sBTV encoding CAE51101.1 |
| 108 | DNA | 14 | VP5 | AJ586714 | BTV14-VP5 used in making sBTV encoding CAE53030.1 |

| | | | | | Figure 7H |
|---|---|---|---|---|---|
| 109 | DNA | 15 | VP2 | AJ585136 | BTV15-VP2 used in making sBTV encoding CAE51102.1 |
| 110 | DNA | 15 | VP5 | AJ586716 | BTV15-VP5 used in making sBTV encoding CAE53032.1 |
| 111 | DNA | 16 | VP2 | AJ585137 | BTV16-VP2 used in making sBTV encoding CAE51103.1 |
| 112 | DNA | 16 | VP5 | AJ586719 | BTV16-VP5 used in making sBTV encoding CAE53035.1 |
| 113 | DNA | 17 | VP2 | AJ585138 | BTV17-VP2 used in making sBTV encoding CAE51104.1 |
| 114 | DNA | 17 | VP5 | AJ586720 | BTV17-VP5 used in making sBTV encoding CAE53036.1 |
| 115 | DNA | 18 | VP2 | AJ585139 | BTV18-VP2 used in making sBTV encoding CAE51105.1 |
| 116 | DNA | 18 | VP5 | AJ586721 | BTV18-VP5 used in making sBTV encoding CAE53037.1 |
| 117 | DNA | 19 | VP2 | AJ585140 | BTV19-VP2 used in making sBTV encoding CAE51106.1 |
| 118 | DNA | 19 | VP5 | AJ586722 | BTV19-VP5 used in making sBTV encoding CAE53038.1 |
| 119 | DNA | 20 | VP2 | AJ585141 | BTV20-VP2 used in making sBTV encoding CAE51107.1 |
| 120 | DNA | 20 | VP5 | AJ586723 | BTV20-VP5 used in making sBTV encoding CAE53039.1 |
| 121 | DNA | 21 | VP2 | AJ585142 | BTV21-VP2 used in making sBTV encoding CAE51108.1 |
| 122 | DNA | 21 | VP5 | AJ586724 | BTV21-VP5 used in making sBTV encoding CAE53040.1 |
| 123 | DNA | 22 | VP2 | AJ585143 | BTV22-VP2 used in making sBTV encoding CAE51109.1 |
| 124 | DNA | 22 | VP5 | AJ586725 | BTV22-VP5 used in making sBTV encoding CAE53041.1 |
| 125 | DNA | 23 | VP2 | AJ585144 | BTV23-VP2 used in making sBTV encoding CAE51110.1 |
| 126 | DNA | 23 | VP5 | AJ586727 | BTV23-VP5 used in making sBTV encoding CAE53043.1 |
| 127 | DNA | 24 | VP2 | AJ585145 | BTV24-VP2 used in making sBTV encoding CAE51111.1 |
| 128 | DNA | 24 | VP5 | AJ586730 | BTV24-VP5 used in making sBTV encoding CAE53046.1 |

Figure 7I

| | | | | | |
|---|---|---|---|---|---|
| 129 | DNA | 25 | VP2 | EU839840 | BTV25-VP2 used in making sBTV encoding ACJ06702.1 |
| 130 | DNA | 25 | VP5 | EU839842 | BTV25-VP5 used in making sBTV encoding ACJ06704.1 |
| 131 | DNA | 26 | VP2 | HM590642 | BTV26-VP2 used in making sBTV encoding AED99447.1 |
| 132 | DNA | 26 | VP5 | JN255159 | BTV26-VP5 used in making sBTV encoding AER60536.1 |
| 133 | PRO | 1 | VP2 | ACR58459.1 | BTV1-VP2 used in making sBTV, encoded by FJ969720 |
| 134 | PRO | 1 | VP5 | ACR58462.1 | BTV1-VP5 used in making sBTV encoded by FJ969723 |
| 135 | PRO | 2 | VP2 | AEO19855.1 | BTV2-VP2 used in making sBTV encoded by JN255863 |
| 136 | PRO | 2 | VP5 | AEO19851.1 | BTV2-VP5 used in making sBTV encoded by JN255867 |
| 137 | PRO | 2 | VP2 | CAE51089.1 | BTV2-VP2 used in making sBTV encoded by AJ585123 |
| 138 | PRO | 2 | VP5 | AEO19851.1 | BTV2-VP5 used in making sBTV encoded by JN255867 |
| 139 | PRO | 3 | VP2 | CAE51090.1 | BTV3-VP2 used in making sBTV encoded by AJ585124 |
| 140 | PRO | 3 | VP5 | CAE53013.1 | BTV3-VP5 used in making sBTV encoded by AJ586697 |
| 141 | PRO | 4 | VP2 | ABB71699.1 | BTV4-VP2 used in making sBTV encoded by DQ191280 |
| 142 | PRO | 4 | VP5 | CAE53015.1 | BTV4-VP5 used in making sBTV encoded by AJ586699 |
| 143 | PRO | 4 | VP2 | CAE51091.1 | BTV4-VP2 used in making sBTV encoded by AJ585125 |
| 144 | PRO | 4 | VP5 | CAE53015.1 | BTV4-VP5 used in making sBTV encoded by AJ586699 |
| 145 | PRO | 5 | VP2 | CAE51092.1 | BTV2-VP2 used in making sBTV encoded by AJ585126 |
| 146 | PRO | 5 | VP5 | CAE53016.1 | BTV5-VP5 used in making sBTV encoded by AJ586700 |
| 147 | PRO | 6 | VP2 | CAE51093.1 | BTV6-VP2 used in making sBTV encoded by AJ585127 |

| Figure 7J ||||||
|---|---|---|---|---|---|
| 148 | PRO | 6 | VP5 | CAE53019.1 | BTV6-VP5 used in making sBTV encoded by AJ586703 |
| 149 | PRO | 7 | VP2 | CAE51094.1 | BTV7-VP2 used in making sBTV encoded by AJ585128 |
| 150 | PRO | 7 | VP5 | CAE53020.1 | BTV7-VP5 used in making sBTV encoded by AJ586704 |
| 151 | PRO | 8 | VP2 | CAM57243.2 | BTV8-VP2 used in making sBTV encoded by AM498052 |
| 152 | PRO | 8 | VP5 | CAM57247.2 | BTV8-VP5 used in making sBTV encoded by AM498056 |
| 153 | PRO | 9 | VP2 | AEO19807.1 | BTV9-VP2 used in making sBTV encoded by JN255903 |
| 154 | PRO | 9 | VP5 | CAE53024.1 | BTV9-VP5 used in making sBTV encoded by AJ586708 |
| 155 | PRO | 9 | VP2 | CAE51096.1 | BTV9-VP2 used in making sBTV encoded by AJ585130 |
| 156 | PRO | 9 | VP5 | CAE53024.1 | BTV9-VP5 used in making sBTV encoded by AJ586708 |
| 157 | PRO | 10 | VP2 | CAE51097.1 | BTV10-VP2 used in making sBTV encoded by AJ585131 |
| 158 | PRO | 10 | VP5 | CAE53025.1 | BTV10-VP5 used in making sBTV encoded by AJ586709 |
| 159 | PRO | 11 | VP2 | CAE51098.1 | BTV11-VP2 used in making sBTV encoded by AJ585132 |
| 160 | PRO | 11 | VP5 | CAE53026.1 | BTV11-VP5 used in making sBTV encoded by AJ586710 |
| 161 | PRO | 12 | VP2 | CAE51099.1 | BTV12-VP2 used in making sBTV encoded by AJ585133 |
| 162 | PRO | 12 | VP5 | CAE53027.1 | BTV12-VP5 used in making sBTV encoded by AJ586711 |
| 163 | PRO | 13 | VP2 | CAE51100.1 | BTV13-VP2 used in making sBTV encoded by AJ585134 |
| 164 | PRO | 13 | VP5 | CAE53029.1 | BTV13-VP5 used in making sBTV encoded by AJ586713 |
| 165 | PRO | 14 | VP2 | CAE51101.1 | BTV14-VP2 used in making sBTV encoded by AJ585135 |

| Figure 7K ||||||
|---|---|---|---|---|---|
| 166 | PRO | 14 | VP5 | CAE53030.1 | BTV14-VP5 used in making sBTV encoded by AJ586714 |
| 167 | PRO | 15 | VP2 | CAE51102.1 | BTV15-VP2 used in making sBTV encoded by AJ585136 |
| 168 | PRO | 15 | VP5 | CAE53032.1 | BTV15-VP5 used in making sBTV encoded by AJ586716 |
| 169 | PRO | 16 | VP2 | CAE51103.1 | BTV16-VP2 used in making sBTV encoded by AJ585137 |
| 170 | PRO | 16 | VP5 | CAE53035.1 | BTV16-VP5 used in making sBTV encoded by AJ586719 |
| 171 | PRO | 17 | VP2 | CAE51104.1 | BTV17-VP2 used in making sBTV encoded by AJ585138 |
| 172 | PRO | 17 | VP5 | CAE53036.1 | BTV17-VP5 used in making sBTV encoded by AJ586720 |
| 173 | PRO | 18 | VP2 | CAE51105.1 | BTV18-VP2 used in making sBTV encoded by AJ585139 |
| 174 | PRO | 18 | VP5 | CAE53037.1 | BTV18-VP5 used in making sBTV encoded by AJ586721 |
| 175 | PRO | 19 | VP2 | CAE51106.1 | BTV19-VP2 used in making sBTV encoded by AJ585140 |
| 176 | PRO | 19 | VP5 | CAE53038.1 | BTV19-VP5 used in making sBTV encoded by AJ586722 |
| 177 | PRO | 20 | VP2 | CAE51107.1 | BTV20-VP2 used in making sBTV encoded by AJ585141 |
| 178 | PRO | 20 | VP5 | CAE53039.1 | BTV20-VP5 used in making sBTV encoded by AJ586723 |
| 179 | PRO | 21 | VP2 | CAE51108.1 | BTV21-VP2 used in making sBTV encoded by AJ585142 |
| 180 | PRO | 21 | VP5 | CAE53040.1 | BTV21-VP5 used in making sBTV encoded by AJ586724 |
| 181 | PRO | 22 | VP2 | CAE51109.1 | BTV22-VP2 used in making sBTV encoded by AJ585143 |
| 182 | PRO | 22 | VP5 | CAE53041.1 | BTV22-VP5 used in making sBTV encoded by AJ586725 |
| 183 | PRO | 23 | VP2 | CAE51110.1 | BTV23-VP2 used in making sBTV encoded by AJ585144 |

| | | | | | Figure 7L |
|---|---|---|---|---|---|
| 184 | PRO | 23 | VP5 | CAE53043.1 | BTV23-VP5 used in making sBTV encoded by AJ586727 |
| 185 | PRO | 24 | VP2 | CAE51111.1 | BTV24-VP2 used in making sBTV encoded by AJ585145 |
| 186 | PRO | 24 | VP5 | CAE53046.1 | BTV24-VP5 used in making sBTV encoded by AJ586730 |
| 187 | PRO | 25 | VP2 | ACJ06702.1 | BTV25-VP2 used in making sBTV encoded by EU839840 |
| 188 | PRO | 25 | VP5 | ACJ06704.1 | BTV25-VP5 used in making sBTV encoded by EU839842 |
| 189 | PRO | 26 | VP2 | AED99447.1 | BTV26-VP2 used in making sBTV encoded by HM590642 |
| 190 | PRO | 26 | VP5 | AER60536.1 | BTV26-VP5 used in making sBTV encoded by JN255159 |
| 191 | DNA | 1 | VP2 | | VP2 5' UTR: (SEQ ID NO:191) GTTAAAATAGTAGCGCG |
| 192 | DNA | 1 | VP2 | | VP2 3' UTR: (SEQ ID NO:192) TCTGCTTGACCGCAGATCCG CGCACTATTAGACTTAC |
| 193 | DNA | 1 | VP5 | | VP5 5' UTR: (SEQ ID NO:193) GTTAAAAAGTGCGCCCTTAG CGAAG |
| 194 | DNA | 1 | VP5 | | VP5 3' UTR: (SEQ ID NO:194) ACGCAGCGACGGGAAGCAC TTACACTTAC |

Evolution of mean rectal temperature after challenge

G1: VP2 high dose (D0+D21)
G2: VP2 high dose (D21)
G3: VP2 low dose (D21)
G4: Vp2+Vp5 (D0+D21);
G5: Vp2+Vp5 (D21);
G6: commercial BR8
G7: Controls Dispersions of Maximal Hyperthermias G1: VP2 high dose (D0+D21)
G2: VP2 high dose (D21)
G3: VP2 low dose (D21)
G4:

Evolution of Mean Daily Clinical Scores

G1: vP2 high dose (D0+D21)
G2: vP2 high dose (D21)
G3: vP2 low dose (D21)
G4: Vp2+Vp5 (D0+D21)
G5: Vp2+Vp5 (D21)
G6: commercial BR8
G7: Controls Dispersions of Global Clinical Scores G1: vP2 high dose (D0+D21)
G2: vP2 high dose (D21)
G3: vP2 low dose (D21)
G4: Vp2+Vp5 (D0+D21)
G5: Vp2+Vp5 (D21)
G6: commercial BR8
G7: Controls

Figure 12

Evolution of mean viraemia titres

G1: vP2 high dose (D0+D21)
G2: vP2 high dose (D21)
G3: vP2 low dose (D21)
G4: Vp2+Vp5 (D0+D21)
G5: Vp2+Vp5 (D21)
G6: commercial BR8
G7: Controls Dispersions of AUC G1: vP2 high dose (D0+D21)
G2: vP2 high dose (D21)
G3: vP2 low dose (D21)
G4: Vp2+Vp5 (D0+D21)
G5: Vp2+Vp5 (D21)
G6: commercial BR8
G7: Controls

Figure 14

Evolution of mean BTV-8 neutralizing antibody titres

G1: vP2 high dose (D0+D21)
G2: vP2 high dose (D21)
G3: vP2 low dose (D21)
G4: Vp2+Vp5 (D0+D21)
G5: Vp2+Vp5 (D21)
G6: commercial BR8
G7: Controls

Figure 15

Plaque morphology of sBTV containing the VP2 and VP5 protein of each serotype

Figure 16

Viral titres of sBTV viruses in BHK-21
(72 hours post-infection, MOI 0.001)

Figure 17

Infectious titre, ELISA, Dot Blot Vp2 for BTV1+BTV8 VP2 (RAS10)

Figure 18

Infectious titre, ELISA, Dot Blot Vp2 for BTV1+BTV8 VP2/VP5 (RAS32)

REASSORTANT BTV AND AHSV VACCINES

CROSS-REFERENCE TO RELATED APPLICATIONS

This application claims priority to U.S. provisional application 61/659,198 filed on Jun. 13, 2012.

FIELD OF THE INVENTION

The present invention relates to compositions for combating Bluetongue Virus (BTV) or African Horse Sickness Virus (AHSV) infection in animals. The present invention provides pharmaceutical compositions comprising a recombinant BTV or AHSV vector, methods of vaccination against the BTV or AHSV, and kits for use with such methods and compositions.

BACKGROUND OF THE INVENTION

Bluetongue (BT) is an arthropod-borne infectious viral disease of ruminants. Cattle and goats may be readily infected with the causative BTV but without extensive vascular injury and therefore these species generally fail to show pronounced clinical signs. In contrast, the disease in sheep is characterized by catarrhal inflammation of the mucous membranes of the mouth, nose and forestomachs, and by inflammation of the coronary bands and laminae of the hoofs. There is an excoriation of the epithelium, and ultimately necrosis of the buccal mucosa; the swollen and inflamed tongue and mouth can take on a blue color from which the disease is named (Spreull 1905). The mortality rate in sheep is estimated at 1-30%.

BTV is the prototype virus of the *Orbivirus* genus (Reoviridae family) and is made up of at least 24 different serotypes (Wilson and Mecham 2000). Different strains of BTV have been identified world-wide throughout tropical and temperate zones. BTV infection has occurred as far as 45° N in Europe, as far as 50° N in Asia and North America, and as far South as 35°. BTV is not contagious between ruminants thus the distribution of BTV is dependent on the presence of arthropod vector species of *Culicoides* sp. (biting midges), with different vector species occurring in different regions of the world. Recent data suggests that genetic drift and founder effect contribute to diversification of individual gene segments of field strains of BTV (Bonneau, Mullens et al. 2001). It has been shown that BTV seropositive animals are resistant to reinfection with the homologous BTV serotype.

BTV infection of ruminants is transient, while infection of the *Culicoides* insect vector is persistent. The duration of viremia depends on the animal species and the strain of BTV. It has been reported that viremia can be very transient in sheep and may last for up to 41 days in BTV-infected individuals, up to 42 days in goats, and up to 100 days in cattle. Since BTV infection of cattle often results in prolonged but not persistent viremia, cattle serve as a reservoir from which virus may be ingested by the *Culicoides* vector and then transmitted to other ruminants (Anderson, Stott et al. 1985; MacLachlan 1994; MacLachlan and Pearson 2004). The ecology of many species of *Culicoides* vectors is poorly understood and their breeding sites are largely uncharacterized, and their rates of dispersal unknown. *Culicoides sonorensis* is the principal vector of BTV in North America. Female *Culicoides* insects become persistently infected with BTV and can transmit the virus after an extrinsic incubation period of up to 14 days (Mullens, Tabachnick et al. 1995). BTV overwintering in temperate zones may occur through vertically infected insect vectors, although recent data indicates that there is reduced expression of the outer capsid genes during persistent BTV infection in larval stages of the insect vectors (White, Wilson et al. 2005).

The virions of BTV have a diameter of ~69 nm with a double-shelled coat (capsid) that sometimes is surrounded by a lipoprotein "pseudo-envelope" derived from the cell membranes of infected cells. The BTV genome includes 10 distinct segments of double-stranded RNA that collectively encode seven structural (VP1 through VP7) and four non-structural (NS1, NS2, NS3 and NS3a) proteins (Roy 1996); 9 of the genome segments are monocistronic whereas segment 10 encodes both NS3 and NS3A using a second, inframe initiation codon. Genomic RNA is encapsidated in the icosahedral virion particle by a double layered protein capsid (Verwoerd, Els et al. 1972). The icosahedral core consists of two major (VP3 and VP7) and three minor proteins (VP1, VP4, VP6) and is surrounded by the outer capsid which consists of VP2 and VP5 that respectively are encoded by genomic segments 2 and 5 (Roy 1996). VP2 is responsible for binding and entry of BTV into cells, neutralization, serotype-specificity and hemagglutination. Multimeric forms of VP2 (dimers and trimers) decorate much of the surface of a VP5 scaffold on the outer surface of viral particles (Hassan and Roy 1999). VP2 varies most amongst the 24 BTV serotypes, and levels of anti-VP2 antibody correlate with virus neutralization in vitro and in vivo (Huismans and Erasmus 1981). VP5 also varies markedly between different serotypes and strains of BTV (de Mattos, de Mattos et al. 1994; DeMaula, Bonneau et al. 2000) and although no VP5-specific neutralizing MAb's have been identified to date, data suggests that this protein has a role in neutralization and serotype determination through its conformational influence on VP2 (Huismans and Erasmus 1981; Roy, Urakawa et al. 1990; DeMaula et al., 2000). Purified VP2, immunoadsorbed with BTV anti-core serum to remove trace amounts of VP7, was injected into sheep. An initial dose of 50 micrograms of VP2 was sufficient to induce VP2-precipitating antibodies as well as neutralizing and hemagglutination-inhibiting antibodies. These sheep were fully protected against challenge with a virulent strain of the same BTV serotype. Lower doses of VP2 still provided a significant level of protection even though no neutralizing antibodies were not detected prior to challenge (Huismans, van der Walt et al. 1987). Recent results show that VP2 and NS1 express epitopes recognized by cytotoxic T-lymphocytes (CTL) (Andrew, Whiteley et al. 1995) while it is unlikely that VP7 and VP5 have CTL epitopes. So far, VP3, VP4, VP6, NS2 and NS3 have not stimulated a CTL response in sheep (Lobato, Coupar et al. 1997). Table 1 (modified from Wilson and Mecham 2000) below summarizes the genes of BTV and their protein function.

TABLE 1

Bluetongue virus genes and encoded proteins with location, properties, and function of proteins

| Genome Segment | Protein | Location | Properties & Function |
| --- | --- | --- | --- |
| L1 (3954 bp) (150 kDa) | VP1 | Within the sub-core at the 5-fold axis | RNA dependent RNA polymerase |
| L2 (2926 bp) (111 kDa) | VP2 | Outer capsid (trimer) | Outer capsid, serotype specific antigen, mammalian cell attachment protein, neutralizing epitopes |
| L3 (2770 bp) (103 kDa) | VP3 | Sub-core capsid layer (T = 2 symmetry) | Innermost protein capsid shell, sub-core capsid layer, self assembles, retains icosahedral symmetry, RNA binding, interacts with internal minor proteins |
| M4 (2011 bp) (76 kDa) | VP4 | Within the sub-core at the 5-fold axis (dimer) | Capping enzyme. guanylyltransferase |
| M5 (1638 bp) (59 kDa) | VP5 | Outer capsid (trimer) | Inner outer capsid protein, can affect virus serotype characteristics |
| M6 (1769 bp) (64 kDa) | NS1 | Cytoplasm | Forms tubules in the cell cytoplasm |
| S7 (1156 bp) (38 kDa) | VP7 | Outer core (T = 13 symmetry, trimer) | Outer core surface protein, immuno-dominant major serogroup specific antigen, attachment protein for vector insect cells, reacts with 'core neutralizing' antibodies |
| S8 (1124 bp) (41 kDa) | NS2 | Cytoplasm, viral inclusion bodies (VIB) | Important viral inclusion body matrix protein, ssRNA binding, phosphorylated, can be associated with outer capsid |
| S9 (1046 bp) (36 kDa) | VP6 | Within the sub-core at the 5-fold axis | ssRNA and dsRNA binding, helicase, NTPase |
| S10 (822 bp) (24 kDa) | NS3, NS3a | Cell membranes | Glycoproteins, membrane proteins, involved in cell exit |

Particular BTV antigenic polypeptides of interest include VP2 and VP5. The icosahedral core consists of two major (VP3 and VP7) and three minor proteins (VP1, VP4, VP6) and is surrounded by the outer capsid which consists of VP2 and VP5 that respectively are encoded by genomic segments 2 and 5 (Roy 1996). VP2 is responsible for binding and entry of BTV into cells, neutralization, serotype-specificity and hemagglutination. Multimeric forms of VP2 (dimers and trimers) decorate much of the surface of a VP5 scaffold on the outer surface of viral particles (Hassan and Roy 1999). VP2 varies most amongst the 24 BTV serotypes, and levels of anti-VP2 antibody correlate with virus neutralization in vitro and in vivo (Huismans and Erasmus 1981). VP5 also varies markedly between different serotypes and strains of BTV (de Mattos, de Mattos et al. 1994; DeMaula, Bonneau et al. 2000) and although no VP5-specific neutralizing MAb's have been identified to date, data suggests that this protein has a role in neutralization and serotype determination through its conformational influence on VP2 (Huismans and Erasmus 1981; Roy, Urakawa et al. 1990; DeMaula et al., 2000). Purified VP2, immunoadsorbed with BTV anti-core serum to remove trace amounts of VP7, was injected into sheep. An initial dose of 50 micrograms of VP2 was sufficient to induce VP2-precipitating antibodies as well as neutralizing and hemagglutination-inhibiting antibodies. These sheep were fully protected against challenge with a virulent strain of the same BTV serotype. Lower doses of VP2 still provided a significant level of protection even though no neutralizing antibodies were detected prior to challenge (Huismans, van der Walt et al. 1987). Recent results show that VP2 and NS1 express epitopes recognized by cytotoxic T-lymphocytes (CTL) (Andrew, Whiteley et al. 1995) while it is unlikely that VP7 and VP5 have CTL epitopes. So far, VP3, VP4, VP6, NS2 and NS3 have not stimulated a CTL response in sheep (Lobato, Coupar et al. 1997), see Table 1.

African Horse Sickness (AHS) is a serious, often fatal, arthropod-borne viral disease of horses and mules (African Horse Sickness, The Merck Veterinary Manual). The mortality rate can be as high as 95% in some forms of this disease. Asymptomatic or mild infections can occur in horses, as well as zebras and donkeys, especially horses that were previously infected with a different serotype of the virus. Infected animals or vectors may carry the virus into AHS-free regions. Some authors speculate that climate change could increase the risk for spread of arthropod-borne diseases such as African Horse Sickness, as recently has occurred with related bluetongue virus (Wilson A et al., Parasitol. Res. 2008; 103:69-77). *Culicoides imicola*, the principal vector for this disease, has made incursions into North Africa and southern Europe. Potential arthropod vectors also exist throughout virtually all regions of the world, including much of the United States and the rest of the Americas.

African Horse Sickness results from infection with the African Horse Sickness Virus, a member of the genus *Orbivirus* in the family Reoviridae. To date, 9 serotypes of African Horse Sickness Virus are known. African Horse Sickness Virus serotype 9 is widespread in endemic regions, while serotypes 1 to 8 are found primarily in limited geographic areas. Serotype 9 has been responsible for the majority of African Horse Sickness outbreaks outside Africa. Serotype 4 caused one outbreak in Spain and Portugal between 1987 and 1990 (Lubroth J., Equine Pract. 1988; 10:26-33).

Initial research on African Horse Sickness Virus resulted in the development of mouse-brain attenuated modified live virus vaccine to African Horse Sickness Virus in the 1930's. These vaccines were refined and resulted in the development of a tissue culture attenuated modified live virus (MLV) vaccine in the 1960's.

Despite the efficacy of this vaccine, it has some inherent limitations including vaccine reactions (including death) in individual animals, varied immune response in individual animals, difficulty in immunizing young animals with passive maternal immunity, possibility of reversion to virulence of vaccine virus, and recombination of vaccine strains following vaccination with possible reversion to virulence (du Plessis M. et al. 1998, Onderstepoort Journal of Veterinary Research 65: 321-329). There are also socio-economic implications with using the MLV vaccine. South Africa has a protocol that allows it to export horses to the European Union and a number of other countries. This protocol also makes it possible for horses from other countries to enter South Africa to compete in various events or stand at stud for a temporary period. The protocol is based on ensuring that horses are adequately vaccinated against African Horse Sickness Virus. Veterinary Authorities are aware of the possible dangers of using the MLV vaccine. Most of these problems would be greatly reduced by the development of alternate African Horse Sickness Virus vaccines.

The African Horse Sickness Virus genome is composed of ten double-stranded RNA segments (Oellermann, R. A. et al., 1970; Bremer, C. W. et al., 1976), which encode at least ten viral proteins. The genome segments are numbered 1-10 in order of their migration in PAGE. Seven of the viral proteins are structural and form the double-shelled virus particle. The outer capsid is composed of two major viral proteins, VP2 and VP5, which determine the antigenic variability of the African Horse Sickness Viruses, while the inner capsid is comprised of two major (VP3 and VP7) and three minor (VP1, VP4 and VP6) viral proteins (Lewis S A and Grubman M J, 1991; Martinez-Torrecuadrada J L et al., 1994); Bremer, C W, et al. 1990; Grubman, M. J. & Lewis, S. A., 1992). VP3 and VP7 are highly conserved among the nine serotypes (Oellermann et al., 1970; Bremer et al., 1990). At least three non-structural proteins, NS1, NS2 and NS3, have been identified (Huismans, H. & Els, H. J., 1979; van Staden, V. & Huismans, H., 1991; Mizukoshi, N. et al., 1992). Recombinant canarypox viruses derived from attenuated viruses have been developed as vectors for the expression of heterologous viral genes. A number of these canarypox constructs have since been licensed as vaccines in many countries, including South Africa, the European Union and the United States of America for use in horses (Minke J M, et al., 2004a and b; Minke J M, et al., 2007; Siger L, et al. 2006) and other species (Poulet H, et al., 2003).

The fact that these vaccines only contain genes of the organism of interest makes them inherently safe (Minke J M, et al., 2004b). Furthermore, the onset of detectable neutralizing antibody is rapid even after a single dose of vaccine (Minke J M et al., 2004b). The inherent safety of such vaccines and the nature of the development of neutralizing antibody make such vaccines particularly attractive for use in epizootics (Minke J M et al., 2004a).

Previous studies have shown that horses develop neutralizing antibodies to AHS when they are inoculated with exogenously expressed VP2 and an appropriate adjuvant (Scanlen M, et al., 2002). Studies in sheep have shown that the neutralizing antibody response to Bluetongue Virus is enhanced by inoculation of sheep with virus-like particles in which VP2 and VP5 are co-expressed (Pearson L D, Roy P, 1993). A recombinant canarypox virus vaccine co-expressing the genes encoding for VP2 and VP5 outer capsid proteins of Bluetongue Virus has recently been shown to induce high levels of protection in sheep (Boone J D, et al., 2007).

It has not been shown that horses develop neutralizing antibodies to African Horse Sickness Virus when inoculated with a vector containing and co-expressing AHSV VP2 and VP5. It can thus be appreciated that the present invention fulfills a need in the art by providing a recombinant poxvirus including compositions and products therefrom, particularly ALVAC-based recombinants and compositions and products therefrom, especially such recombinants expressing AHSV VPs 2 and 5 or any combination thereof and compositions and products therefrom.

Studies relating to genetic modification of BTV or AHSV have been described by Piet P A van Rijn et al. (Virology Journal, 2010, 7:261), Polly Roy et al. (Journal of Viology, 2011, 85, 19; 10213-10221), Polly Roy et al. (Journal of Viology, 2008, p 8339-8348), Massimo Palmarini et al. (PloS pathogens, 2011, 7(12): e1002477), and in WO2009/068870.

Thus, it would be advantageous to provide improved immunogenic and vaccine compositions against BTV and AHSV, and methods for making and using such compositions, including such compositions that provide for differential diagnostic methods, assays and kits.

Considering the susceptibility of animals, including humans, to BTV or AHSV, a method of preventing BTV or AHSV infection and protecting animals is essential. Accordingly, there is a need for an effective vaccine against BTV or AHSV.

SUMMARY OF THE INVENTION

Compositions comprising one or more recombinant reassortant BTV or AHSV vectors comprising one or more heterologous polynucleotides encoding at least one antigens of BTV or AHSV are provided.

Methods of the invention include methods for making the recombinant reassortant BTV or AHSV compositions or vectors. Methods also include methods of use including administering to an animal an effective amount of the compositions or vectors to produce a protective immunogenic response.

BRIEF DESCRIPTION OF THE DRAWINGS

The following detailed description, given by way of example, but not intended to limit the invention solely to the specific embodiments described, may best be understood in conjunction with the accompanying drawings, in which:

FIGS. 1A and 1B depict schematic graph of reassortant BTV-1 and BTV-8 and flow chart of generating the recombinant reassortant BTV vectors.

FIG. 2 depicts the average plaue diameters of the BTV reassortants.

FIG. 3 depicts the growth curve analyses of reassortant viruses. Most reassortants grow similarly to the wild-type parental viruses.

FIG. 4 depicts the BTV neutralization results.

FIG. 5 depicts the generation of BTV reassortants.

FIG. 6 depicts the schematic graph of generating BTV reassortants using reverse genetics.

FIGS. 7A-7L show the table containing the SEQ ID NO assignment and DNA and protein sequences.

FIG. 12 depicts the evolution of mean viraemia titres.

FIG. 14 depicts the evolution of mean BTV-8 neutralizing antibody titres.

FIG. 15 depicts the plaque morphology of sBTV containing the VP2 and VP5 protein of each serotype.

FIG. 16 depicts the viral titres of sBTV viruses in BHK-21.

FIG. 17 depicts the infectious titre, ELISA, Dot Blot Vp2 for BTV1+BTV8 VP2 (RAS10).

FIG. 18 depicts depicts the infectious titre, ELISA, Dot Blot Vp2 for BTV1+BTV8 VP2NP5 (RAS32).

DETAILED DESCRIPTION

Figure 8:
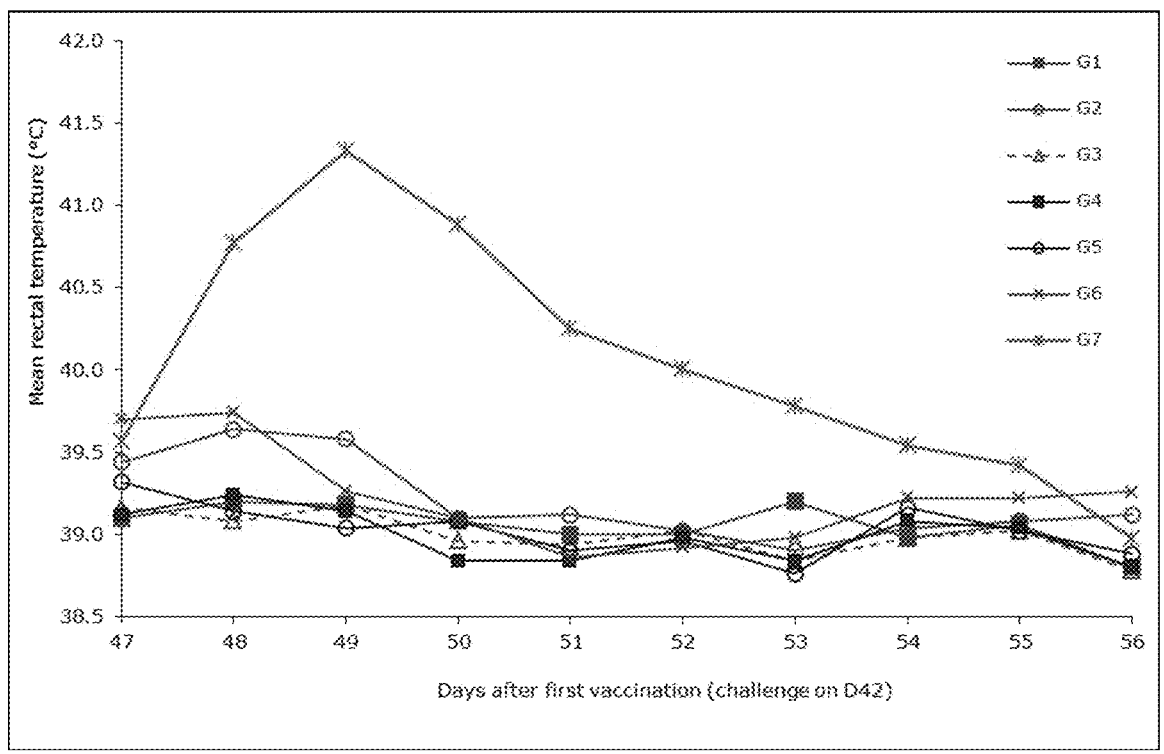
FIG. 8 depicts the evolution of mean rectal temperature after challenge.

Compositions comprising one or more recombinant BTV or AHSV vectors comprising one or more heterologous polynucleotides encoding at least one antigens of BTV or AHSV that elicit an immunogenic response in an animal are provided. In one embodiment the polypeptide antigen is a BTV VP2 or VP5 polypeptide or active fragment or variant thereof.

It is recognized that the antigenic polypeptides of the invention may be full length polypeptides or active fragments or variants thereof. By "active fragments" or "active variants" is intended that the fragments or variants retain the antigenic nature of the polypeptide. Thus, the present invention encompasses any BTV or AHSV polypeptide, antigen, epitope or immunogen that elicits an immunogenic response in an animal. The BTV or AHSV polypeptide, antigen, epitope or immunogen may be any BTV or AHSV polypeptide, antigen, epitope or immunogen, such as, but not limited to, a protein, peptide or fragment or variant thereof, that elicits, induces or stimulates a response in an animal, such as an ovine, bovine, caprine or equine.

The present invention relates to bovine, ovine, caprine, or equine vaccines or compositions which may comprise an effective amount of a recombinant BTV or AHSV vector and a pharmaceutically or veterinarily acceptable carrier, excipient, adjuvant, or vehicle.

In some embodiments, the vaccines further comprise adjuvants, such as the oil-in-water (O/W) emulsions described in U.S. Pat. No. 7,371,395.

In still other embodiments, the adjuvants include EMULSIGEN, Aluminum Hydroxide and Saponin, and CpG, or combinations thereof.

In some embodiments, the response in the animal is a protective immune response.

By "animal" it is intended mammals, birds, and the like. Animal or host includes mammals and human. The animal may be selected from the group consisting of equine (e.g., horse), canine (e.g., dogs, wolves, foxes, coyotes, jackals), feline (e.g., lions, tigers, domestic cats, wild cats, other big cats, and other felines including cheetahs and lynx), ovine (e.g., sheep), bovine (e.g., cattle), porcine (e.g., pig), caprine (e.g., goat), avian (e.g., chicken, duck, goose, turkey, quail, pheasant, parrot, finches, hawk, crow, ostrich, emu and cassowary), primate (e.g., prosimian, tarsier, monkey, gibbon, ape), and fish. The term "animal" also includes an individual animal in all stages of development, including embryonic and fetal stages.

Unless otherwise explained, all technical and scientific terms used herein have the same meaning as commonly understood by one of ordinary skill in the art to which this disclosure belongs. The singular terms "a", "an", and "the" include plural referents unless context clearly indicates otherwise. Similarly, the word "or" is intended to include "and" unless the context clearly indicate otherwise.

It is noted that in this disclosure and particularly in the claims and/or paragraphs, terms such as "comprises", "comprised", "comprising" and the like can have the meaning attributed to it in U.S. patent law; e.g., they can mean "includes", "included", "including", and the like; and that terms such as "consisting essentially of" and "consists essentially of" have the meaning ascribed to them in U.S. patent law, e.g., they allow for elements not explicitly recited, but exclude elements that are found in the prior art or that affect a basic or novel characteristic of the invention.

The terms "recombinant BTV or AHSV vector(s)", "recombinant reassortant BTV or AHSV vector(s)", "reassortant BTV or AHSV", "BTV or AHSV reassortants" are used interchangeably herein to refer to any modification, alteration or engineering of a BTV or AHSV virus. The modification, alteration or engineering of a BTV or AHSV virus may include, but is not limited to, deletion of one or more nucleotides or amino acids, deletion of an entire gene, codon-optimization of a gene, conservative substitution of amino acids, insertion of one or more heterologous polynucleotides, mixing of genes, transcripts, RNA segments, DNA segments of different serotypes or species into new combinations.

The antigenic polypeptides of the invention are capable of protecting against BTV and AHSV. That is, they are capable of stimulating an immune response in an animal. By "antigen" or "immunogen" means a substance that induces a specific immune response in a host animal. The antigen may comprise a whole organism, killed, attenuated or live; a subunit or portion of an organism; a recombinant vector containing an insert with immunogenic properties; a piece or fragment of DNA capable of inducing an immune response upon presentation to a host animal; a polypeptide, an epitope, a hapten, or any combination thereof. Alternately, the immunogen or antigen may comprise a toxin or antitoxin.

The term "immunogenic protein, polypeptide, or peptide" as used herein includes polypeptides that are immunologically active in the sense that once administered to the host, it is able to evoke an immune response of the humoral and/or cellular type directed against the protein. Preferably the protein fragment is such that it has substantially the same immunological activity as the total protein. Thus, a protein fragment according to the invention comprises or consists essentially of or consists of at least one epitope or antigenic determinant. An "immunogenic" protein or polypeptide, as used herein, includes the full-length sequence of the protein, analogs thereof, or immunogenic fragments thereof. By "immunogenic fragment" is meant a fragment of a protein which includes one or more epitopes and thus elicits the immunological response described above. Such fragments can be identified using any number of epitope mapping techniques, well known in the art. See, e.g., Epitope Mapping Protocols in Methods in Molecular Biology, Vol. 66 (Glenn E. Morris, Ed., 1996). For example, linear epitopes may be determined by e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al., 1984; Geysen et al., 1986. Similarly, conformational epitopes are readily identified by determining spatial conformation of amino acids such as by, e.g., x-ray crystallography and 2-dimensional nuclear magnetic resonance. See, e.g., Epitope Mapping Protocols, supra.

As discussed the invention encompasses active fragments and variants of the antigenic polypeptide. Thus, the term "immunogenic protein, polypeptide, or peptide" further contemplates deletions, additions and substitutions to the sequence, so long as the polypeptide functions to produce an immunological response as defined herein. The term "conservative variation" denotes the replacement of an amino acid residue by another biologically similar residue, or the replacement of a nucleotide in a nucleic acid sequence such that the encoded amino acid residue does not change or is another biologically similar residue. In this regard, particularly preferred substitutions will generally be conservative in nature, i.e., those substitutions that take place within a family of amino acids. For example, amino acids are generally divided into four families: (1) acidic—aspartate and glutamate; (2) basic—lysine, arginine, histidine; (3) non-polar—alanine, valine, leucine, isoleucine, proline, phenylalanine, methionine, tryptophan; and (4) uncharged polar—glycine, asparagine, glutamine, cysteine, serine, threonine, tyrosine. Phenylalanine, tryptophan, and tyrosine are sometimes classified as aromatic amino acids. Examples of conservative variations include the substitution of one hydrophobic residue such as isoleucine, valine, leucine or methionine for another hydrophobic residue, or the substitution of one polar residue for another polar residue, such as the substitution of arginine for lysine, glutamic acid for aspartic acid, or glutamine for asparagine, and the like; or a similar conservative replacement of an amino acid with a structurally related amino acid that will not have a major effect on the biological activity. Proteins having substantially the same amino acid sequence as the reference molecule but possessing minor amino acid substitutions that do not substantially affect the immunogenicity of the protein are, therefore, within the definition of the reference polypeptide. All of the polypeptides produced by these modifications are included herein. The term "conservative variation" also includes the use of a substituted amino acid in place of an unsubstituted parent amino acid provided that antibodies raised to the substituted polypeptide also immunoreact with the unsubstituted polypeptide.

The term "epitope" refers to the site on an antigen or hapten to which specific B cells and/or T cells respond. The term is also used interchangeably with "antigenic determinant" or "antigenic determinant site". Antibodies that recognize the same epitope can be identified in a simple immunoassay showing the ability of one antibody to block the binding of another antibody to a target antigen.

An "immunological response" to a composition or vaccine is the development in the host of a cellular and/or antibody-mediated immune response to a composition or vaccine of interest. Usually, an "immunological response" includes but is not limited to one or more of the following effects: the production of antibodies, B cells, helper T cells, and/or cytotoxic T cells, directed specifically to an antigen or antigens included in the composition or vaccine of interest. Preferably, the host will display either a therapeutic or protective immunological response such that resistance to new infection will be enhanced and/or the clinical severity of the disease reduced. Such protection will be demonstrated by either a reduction or lack of symptoms normally displayed by an infected host, a quicker recovery time and/or a lowered viral titer in the infected host.

Synthetic antigens are also included within the definition, for example, polyepitopes, flanking epitopes, and other recombinant or synthetically derived antigens. See, e.g., Bergmann et al., 1993; Bergmann et al., 1996; Suhrbier, 1997; Gardner et al., 1998. Immunogenic fragments, for purposes of the present invention, will usually include at least about 3 amino acids, at least about 5 amino acids, at least about 10-15 amino acids, or about 15-25 amino acids or more amino acids, of the molecule. There is no critical upper limit to the length of the fragment, which could comprise nearly the full-length of the protein sequence, or even a fusion protein comprising at least one epitope of the protein.

Accordingly, a minimum structure of a polynucleotide expressing an epitope is that it comprises or consists essentially of or consists of nucleotides encoding an epitope or antigenic determinant of a BTV or AHSV polypeptide. A polynucleotide encoding a fragment of a BTV or AHSV polypeptide may comprise or consist essentially of or consist of a minimum of 15 nucleotides, about 30-45 nucleotides, about 45-75, or at least 57, 87 or 150 consecutive or contiguous nucleotides of the sequence encoding the polypeptide. Epitope determination procedures, such as, generating overlapping peptide libraries (Hemmer et al., 1998), Pepscan (Geysen et al., 1984; Geysen et al., 1985; Van der Zee R. et al., 1989; Geysen, 1990; Multipin. RTM. Peptide Synthesis Kits de Chiron) and algorithms (De Groot et al., 1999; PCT/US2004/022605) can be used in the practice of the invention.

The term "nucleic acid" and "polynucleotide" refers to RNA or DNA that is linear or branched, single or double stranded, or a hybrid thereof. The term also encompasses RNA/DNA hybrids. The following are non-limiting examples of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes and primers. A polynucleotide may comprise modified nucleotides, such as methylated nucleotides and nucleotide analogs, uracyl, other sugars and linking groups such as fluororibose and thiolate, and nucleotide branches. The sequence of nucleotides may be further modified after polymerization, such as by conjugation, with a labeling component. Other types of modifications included in this definition are caps, substitution of one or more of the naturally occurring nucleotides with an analog, and introduction of means for attaching the polynucleotide to proteins, metal ions, labeling components, other polynucleotides or solid support. The polynucleotides can be obtained by chemical synthesis or derived from a microorganism.

The term "gene" is used broadly to refer to any segment of polynucleotide associated with a biological function. Thus, genes include introns and exons as in genomic sequence, or just the coding sequences as in cDNAs and/or the regulatory sequences required for their expression. For example, gene also refers to a nucleic acid fragment that expresses mRNA or functional RNA, or encodes a specific protein, and which includes regulatory sequences.

The terms "protein", "peptide", "polypeptide" and "polypeptide fragment" are used interchangeably herein to refer to polymers of amino acid residues of any length. The polymer can be linear or branched, it may comprise modified amino acids or amino acid analogs, and it may be interrupted by chemical moieties other than amino acids. The terms also encompass an amino acid polymer that has been modified naturally or by intervention; for example disulfide bond formation, glycosylation, lipidation, acetylation, phosphorylation, or any other manipulation or modification, such as conjugation with a labeling or bioactive component.

An "isolated" biological component (such as a nucleic acid or protein or organelle) refers to a component that has been substantially separated or purified away from other biological components in the cell of the organism in which the component naturally occurs, for instance, other chromosomal and extra-chromosomal DNA and RNA, proteins, and organelles. Nucleic acids and proteins that have been "isolated" include nucleic acids and proteins purified by standard purification methods. The term also embraces nucleic acids and proteins prepared by recombinant technology as well as chemical synthesis.

The term "purified" as used herein does not require absolute purity; rather, it is intended as a relative term. Thus, for example, a purified polypeptide preparation is one in which the polypeptide is more enriched than the polypeptide is in its natural environment. That is the polypeptide is separated from cellular components. By "substantially purified" it is intended that such that the polypeptide represents several embodiments at least 60%, at least 70%, at least 80%, at least 90%, at least 95%, or at least 98%, or more of the cellular components or materials have been removed. Likewise, the polypeptide may be partially purified. By "partially purified" is intended that less than 60% of the cellular components or material is removed. The same applies to polynucleotides. The polypeptides disclosed herein can be purified by any of the means known in the art.

As noted above, the antigenic polypeptides or fragments or variants thereof are BTV or AHSV antigenic polypeptides. Fragments and variants of the disclosed polynucleotides and polypeptides encoded thereby are also encompassed by the present invention. By "fragment" is intended a portion of the polynucleotide or a portion of the antigenic amino acid sequence encoded thereby. Fragments of a polynucleotide may encode protein fragments that retain the biological activity of the native protein and hence have immunogenic activity as noted elsewhere herein. Fragments of the polypeptide sequence retain the ability to induce a protective immune response in an animal.

"Variants" is intended to mean substantially similar sequences. For polynucleotides, a variant comprises a deletion and/or addition of one or more nucleotides at one or more sites within the native polynucleotide and/or a substitution of one or more nucleotides at one or more sites in the native polynucleotide. As used herein, a "native" polynucleotide or polypeptide comprises a naturally occurring nucleotide sequence or amino acid sequence, respectively. Variants of a particular polynucleotide of the invention (i.e., the reference polynucleotide) can also be evaluated by comparison of the percent sequence identity between the polypeptide encoded by a variant polynucleotide and the polypeptide encoded by the reference polynucleotide. "Variant" protein is intended to mean a protein derived from the native protein by deletion or addition of one or more amino acids at one or more sites in the native protein and/or substitution of one or more amino acids at one or more sites in the native protein. Variant proteins encompassed by the present invention are biologically active, that is they the ability to elicit an immune response.

In one embodiment, the present invention provides composition or vaccine comprising one or more recombinant BTV or AHSV vectors comprising one or more heterologous polynucleotides encoding at least one polypeptides of BTV or AHSV. The polypeptides may be any BTV or AHSV polypeptides selected from the group consisting of VP1, VP2, VP3, VP4, VP6, VPS, VP7, NS1, NS2, and NS3/3A. In one aspect, the recombinant BTV or AHSV vectors comprise the vector backbone derived from the genomes of BTV or AHSV serotypes 1, 2, 3, 4, 5, 6, 7, 8, 9, 10, 11, 12, 13, 14, 15, 16, 17, 18, 19, 20, 21, 22, 23, 24, 25, and 26. In another aspect, the heterologous polynucleotides encode the antigens from a serotype of BTV or AHSV that is different from the serotype of BTV or AHSV used as the vector backbone.

In another embodiment, the recombinant BTV or AHSV vectors comprise heterologous polynucleotides encoding polypeptides VP1, VP2, VP3, VP4, VP5, VP7, NS1, NS2, VP6, and NS3/3A, wherein the polypeptides may be from different serotypes of BTV or AHSV, such as serotypes 1, 2, 3, 4, 5, 6, 7, 8, 9, 10, 11, 12, 13, 14, 15, 16, 17, 18, 19, 20, 21, 22, 23, 24, 25, and 26. The different combinations of polypeptides from different serotypes of BTV or AHSV may be illustrated in the following tables. The nomenclaure used for the recombinant reassortant BTV (or AHSV) vectors in the present invention is defined as: the upper case section of the name refers to the backbone of the virus, followed by a subscript comprising the protein(s) substituted, preceded by the serotype origin of the segment, for example BTV-$1_{8VP1}$ refers to a virus with a BTV-1 backbone containing the VP1 gene of BTV-8.

TABLE 1 some examples of reassortant BTV comprising one or two polypeptides from one BTV serotype and nine or eight polypeptides from another BTV serotype

|  | VP1 | VP2 | VP3 | VP4 | VP5 | VP6 | VP7 | NS1 | NS2 | NS3/3A |
|---|---|---|---|---|---|---|---|---|---|---|
| BTV-1 | 1 | 1 | 1 | 1 | 1 | 1 | 1 | 1 | 1 | 1 |
| BTV-$1_{8VP1VP2}$ | 8 | 1 | 1 | 1 | 1 | 1 | 1 | 1 | 1 | 1 |
| BTV-$1_{8VP2}$ | 1 | 8 | 1 | 1 | 1 | 1 | 1 | 1 | 1 | 1 |
| BTV-$1_{8VP3}$ | 1 | 1 | 8 | 1 | 1 | 1 | 1 | 1 | 1 | 1 |
| BTV-$1_{8VP4}$ | 1 | 1 | 1 | 8 | 1 | 1 | 1 | 1 | 1 | 1 |
| BTV-$1_{8VP5}$ | 1 | 1 | 1 | 1 | 8 | 1 | 1 | 1 | 1 | 1 |
| BTV-$1_{8VP6}$ | 1 | 1 | 1 | 1 | 1 | 8 | 1 | 1 | 1 | 1 |
| BTV-$1_{8VP7}$ | 1 | 1 | 1 | 1 | 1 | 1 | 8 | 1 | 1 | 1 |
| BTV-$1_{8NS1}$ | 1 | 1 | 1 | 1 | 1 | 1 | 1 | 8 | 1 | 1 |
| BTV-$1_{8NS2}$ | 1 | 1 | 1 | 1 | 1 | 1 | 1 | 1 | 8 | 1 |
| BTV-$1_{8NS3/3A}$ | 1 | 1 | 1 | 1 | 1 | 1 | 1 | 1 | 1 | 8 |
| BTV-8 | 8 | 8 | 8 | 8 | 8 | 8 | 8 | 8 | 8 | 8 |
| BTV-$8_{1VP1}$ | 1 | 8 | 8 | 8 | 8 | 8 | 8 | 8 | 8 | 8 |
| BTV-$8_{1VP2}$ | 8 | 1 | 8 | 8 | 8 | 8 | 8 | 8 | 8 | 8 |
| BTV-$8_{1VP3}$ | 8 | 8 | 1 | 8 | 8 | 8 | 8 | 8 | 8 | 8 |

TABLE 1-continued some examples of reassortant BTV comprising one or two polypeptides from one BTV serotype and nine or eight polypeptides from another BTV serotype

| | VP1 | VP2 | VP3 | VP4 | VP5 | VP6 | VP7 | NS1 | NS2 | NS3/3A |
|---|---|---|---|---|---|---|---|---|---|---|
| BTV-8$_{1VP4}$ | 8 | 8 | 8 | 1 | 8 | 8 | 8 | 8 | 8 | 8 |
| BTV-8$_{1VP5}$ | 8 | 8 | 8 | 8 | 1 | 8 | 8 | 8 | 8 | 8 |
| BTV-8$_{1VP6}$ | 8 | 8 | 8 | 8 | 8 | 1 | 8 | 8 | 8 | 8 |
| BTV-8$_{1VP7}$ | 8 | 8 | 8 | 8 | 8 | 8 | 1 | 8 | 8 | 8 |
| BTV-8$_{1NS1}$ | 8 | 8 | 8 | 8 | 8 | 8 | 8 | 1 | 8 | 8 |
| BTV-8$_{1NS2}$ | 8 | 8 | 8 | 8 | 8 | 8 | 8 | 8 | 1 | 8 |
| BTV-8$_{1NS3/3A}$ | 8 | 8 | 8 | 8 | 8 | 8 | 8 | 8 | 8 | 1 |
| BTV-1$_{8VP1, VP2}$ | 8 | 8 | 1 | 1 | 1 | 1 | 1 | 1 | 1 | 1 |
| BTV-1$_{8VP2, VP3}$ | 1 | 8 | 8 | 1 | 1 | 1 | 1 | 1 | 1 | 1 |
| BTV-1$_{8VP2, VP5}$ | 1 | 8 | 1 | 1 | 8 | 1 | 1 | 1 | 1 | 1 |
| BTV-8$_{1VP1, VP2}$ | 1 | 1 | 8 | 8 | 8 | 8 | 8 | 8 | 8 | 8 |
| BTV-8$_{1VP2, VP3}$ | 8 | 1 | 1 | 8 | 8 | 8 | 8 | 8 | 8 | 8 |
| BTV-8$_{1VP2, VP5}$ | 8 | 1 | 8 | 8 | 1 | 8 | 8 | 8 | 8 | 8 |

The present invention encompasses the recombinant BTV vectors comprising the reassortant BTV having the formula BTV-A$_{BVPa}$, BTV-A$_{BVPc,VPd}$, BTV-A$_{BNSe}$, BTV-A$_{BVPc,NSe}$, wherein A and B=1, 2, 3, 4, 5, 6, 7, 8, 9, 10, 11, 12, 13, 14, 15, 16, 17, 18, 19, 20, 21, 22, 23, 24, 25, and 26 (for BTV or AHSV serotypes); c and d=1, 2, 3, 4, 5, 6, and 7 (for VP1, VP2, VP3, VP4, VP5, VP6 or VP7); e=1, 2, and 3/3A (for NS1, NS2 or NS3/3A).

In another aspect, the present invention provides a BTV polypeptide having a sequence as set forth in SEQ ID NO:1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, or 190, and variant or fragment thereof.

Moreover, homologs of BTV or AHSV polypeptides from ovine, bovine, caprine, or equine are intended to be within the scope of the present invention. As used herein, the term "homologs" includes orthologs, analogs and paralogs. The term "analogs" refers to two polynucleotides or polypeptides that have the same or similar function, but that have evolved separately in unrelated organisms. The term "orthologs" refers to two polynucleotides or polypeptides from different species, but that have evolved from a common ancestral gene by speciation. Normally, orthologs encode polypeptides having the same or similar functions. The term "paralogs" refers to two polynucleotides or polypeptides that are related by duplication within a genome. Paralogs usually have different functions, but these functions may be related. Analogs, orthologs, and paralogs of a wild-type BTV or AHSV polypeptide can differ from the wild-type BTV polypeptide by post-translational modifications, by amino acid sequence differences, or by both. In particular, homologs of the invention will generally exhibit at least 80-85%, 85-90%, 90-95%, or 95%, 96%, 97%, 98%, 99% sequence identity, with all or part of the wild-type BTV or AHSV or polynucleotide sequences, and will exhibit a similar function. Variants include allelic variants. The term "allelic variant" refers to a polynucleotide or a polypeptide containing polymorphisms that lead to changes in the amino acid sequences of a protein and that exist within a natural population (e.g., a virus species or variety). Such natural allelic variations can typically result in 1-5% variance in a polynucleotide or a polypeptide. Allelic variants can be identified by sequencing the nucleic acid sequence of interest in a number of different species, which can be readily carried out by using hybridization probes to identify the same gene genetic locus in those species. Any and all such nucleic acid variations and resulting amino acid polymorphisms or variations that are the result of natural allelic variation and that do not alter the functional activity of gene of interest, are intended to be within the scope of the invention.

As used herein, the term "derivative" or "variant" refers to a polypeptide, or a nucleic acid encoding a polypeptide, that has one or more conservative amino acid variations or other minor modifications such that (1) the corresponding polypeptide has substantially equivalent function when compared to the wild type polypeptide or (2) an antibody raised against the polypeptide is immunoreactive with the wild-type polypeptide. These variants or derivatives include polypeptides having minor modifications of the BTV or AHSV polypeptide primary amino acid sequences that may result in peptides which have substantially equivalent activity as compared to the unmodified counterpart polypeptide. Such modifications may be deliberate, as by site-directed mutagenesis, or may be spontaneous. The term "variant" further contemplates deletions, additions and substitutions to the sequence, so long as the polypeptide functions to produce an immunological response as defined herein.

The term "conservative variation" denotes the replacement of an amino acid residue by another biologically similar residue, or the replacement of a nucleotide in a nucleic acid sequence such that the encoded amino acid residue does not change or is another biologically similar residue. In this regard, particularly preferred substitutions will generally be conservative in nature, as described above.

The polynucleotides of the disclosure include sequences that are degenerate as a result of the genetic code, e.g., optimized codon usage for a specific host. As used herein, "optimized" refers to a polynucleotide that is genetically engineered to increase its expression in a given species. To provide optimized polynucleotides coding for BTV or AHSV polypeptides, the DNA sequence of the BTV or AHSV protein gene can be modified to 1) comprise codons preferred by highly expressed genes in a particular species; 2) comprise an A+T or G+C content in nucleotide base composition to that substantially found in said species; 3) form an initiation sequence of said species; or 4) eliminate sequences that cause destabilization, inappropriate polyadenylation, degradation and termination of RNA, or that form secondary structure hairpins or RNA splice sites. Increased expression of BTV or AHSV protein in said species can be achieved by utilizing the distribution frequency of codon usage in eukaryotes and prokaryotes, or in a particular species. The term "frequency of preferred codon usage" refers to the preference exhibited by a specific host cell in usage of nucleotide codons to specify a given amino acid. There are 20 natural amino acids, most of which are specified by more than one codon. Therefore, all degenerate nucleotide sequences are included in the disclosure as long as the amino acid sequence of the BTV or AHSV polypeptide encoded by the nucleotide sequence is functionally unchanged.

The sequence identity between two amino acid sequences may be established by the NCBI (National Center for Biotechnology Information) pairwise blast and the blosum62 matrix, using the standard parameters (see, e.g., the BLAST or BLASTX algorithm available on the "National Center for Biotechnology Information" (NCBI, Bethesda, Md., USA) server, as well as in Altschul et al.; and thus, this document speaks of using the algorithm or the BLAST or BLASTX and BLOSUM62 matrix by the term "blasts").

The "identity" with respect to sequences can refer to the number of positions with identical nucleotides or amino acids divided by the number of nucleotides or amino acids in the shorter of the two sequences wherein alignment of the two sequences can be determined in accordance with the Wilbur and Lipman algorithm (Wilbur and Lipman), for instance, using a window size of 20 nucleotides, a word length of 4 nucleotides, and a gap penalty of 4, and computer-assisted analysis and interpretation of the sequence data including alignment can be conveniently performed using commercially available programs (e.g., Intelligenetics™ Suite, Intelligenetics Inc. CA). When RNA sequences are said to be similar, or have a degree of sequence identity or homology with DNA sequences, thymidine (T) in the DNA sequence is considered equal to uracil (U) in the RNA sequence. Thus, RNA sequences are within the scope of the invention and can be derived from DNA sequences, by thymidine (T) in the DNA sequence being considered equal to uracil (U) in RNA sequences.

The sequence identity or sequence similarity of two amino acid sequences, or the sequence identity between two nucleotide sequences can be determined using Vector NTI software package (Invitrogen, 1600 Faraday Ave., Carlsbad, Calif.).

The following documents provide algorithms for comparing the relative identity or homology of sequences, and additionally or alternatively with respect to the foregoing, the teachings in these references can be used for determining percent homology or identity: Needleman S B and Wunsch C D; Smith T F and Waterman M S; Smith T F, Waterman M S and Sadler J R; Feng D F and Dolittle R F; Higgins D G and Sharp P M; Thompson J D, Higgins D G and Gibson T J; and, Devereux J, Haeberlie P and Smithies O. And, without undue experimentation, the skilled artisan can consult with many other programs or references for determining percent homology.

Hybridization reactions can be performed under conditions of different "stringency." Conditions that increase stringency of a hybridization reaction are well known. See for example, "Molecular Cloning: A Laboratory Manual", second edition (Sambrook et al., 1989).

The invention further encompasses the BTV polynucleotides contained in a vector molecule or an expression vector and operably linked to a promoter element and optionally to an enhancer.

A "vector" refers to a recombinant DNA or RNA plasmid or virus that comprises a heterologous polynucleotide to be delivered to a target cell, either in vitro or in vivo. The heterologous polynucleotide may comprise a sequence of interest for purposes of prevention or therapy, and may optionally be in the form of an expression cassette. As used herein, a vector needs not be capable of replication in the ultimate target cell or subject. The term includes cloning vectors and viral vectors.

The term "recombinant" means a polynucleotide semi-synthetic, or synthetic origin which either does not occur in nature or is linked to another polynucleotide in an arrangement not found in nature.

"Heterologous" means derived from a genetically distinct entity from the rest of the entity to which it is being compared. For example, a polynucleotide may be placed by genetic engineering techniques into a plasmid or vector derived from a different source, and is a heterologous polynucleotide. A promoter removed from its native coding sequence and operatively linked to a coding sequence other than the native sequence is a heterologous promoter.

The present invention relates to ovine, bovine, caprine and porcine vaccines or pharmaceutical or immunological compositions which may comprise an effective amount of a recombinant BTV antigens and a pharmaceutically or veterinarily acceptable carrier, excipient, adjuvant, or vehicle.

The subject matter described herein is directed in part, to compositions and methods related to the BTV antigen prepared in a plant or alga expression system that was highly immunogenic and protected animals against challenge from homologous and heterologous BTV strains.

The present invention relates to a composition or vaccine comprising one or more recombinant BTV or AHSV vectors comprising one or more heterologous polynucleotides encoding at least one polypeptides of BTV or AHSV and a pharmaceutically or veterinarily acceptable carrier, excipient, adjuvant, or vehicle.

In another embodiment, pharmaceutically or veterinarily acceptable carrier, excipient, adjuvant, or vehicle may be a water-in-oil emulsion. In yet another embodiment, the water-in-oil emulsion may be a water/oil/water (W/O/W) triple emulsion.

The invention further encompasses the BTV polynucleotides contained in a vector molecule or an expression vector and operably linked to a promoter element and optionally to an enhancer.

In another aspect, the present invention provides a polypeptide having at least 70%, at least 75%, at least 80%, at least 85%, at least 90%, at least 95%, 96%, 97%, 98% or 99% sequence identity to an antigenic polypeptide of the invention, particularly to the polypeptides having a sequence as set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, or 190.

In yet another aspect, the present invention provides fragments and variants of the BTV polypeptides identified above (SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, or 190) which may readily be prepared by one of skill in the art using well-known molecular biology techniques.

Variants are homologous polypeptides having an amino acid sequence at least 75%, 80%, 85%, 90%, 95%, 96%, 97%, 98%, or 99% identity to the amino acid sequence as set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, or 190.

In another aspect, the present invention provides a polynucleotide encoding a BTV polypeptide, such as a polynucleotide encoding a polypeptide having a sequence as set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, or 190. In yet another aspect, the present invention provides a polynucleotide encoding a polypeptide having at least 70%, at least 75%, at least 80%, at least 85%, at least 90%, at least 95%, 96%, 97%, 98% or 99% sequence identity to a polypeptide having a sequence as set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, or 190, or a conservative variant, an allelic variant, a homolog or an immunogenic fragment comprising at least eight or at least ten consecutive amino acids of one of these polypeptides, or a combination of these polypeptides.

In another aspect, the present invention provides a polynucleotide having a nucleotide sequence as set forth in SEQ ID NO: 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, or 132, or a variant thereof. In yet another aspect, the present invention provides a polynucleotide having at least 70%, at least 75%, at least 80%, at least 85%, at least 90%, at least 95%, at least 95%, 96%, 97%, 98% or 99% sequence identity to one of a polynucleotide having a sequence as set forth in SEQ ID NO: 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, or 132, or a variant thereof.

The polynucleotides of the invention may comprise additional sequences, such as additional encoding sequences within the same transcription unit, controlling elements such as promoters, ribosome binding sites, 5'UTR, 3'UTR, transcription terminators, polyadenylation sites, additional transcription units under control of the same or a different promoter, sequences that permit cloning, expression, homologous recombination, and transformation of a host cell, and any such construct as may be desirable to provide embodiments of this invention.

Elements for the expression of a BTV or AHSV polypeptide, antigen, epitope or immunogen are advantageously present in an inventive vector. In minimum manner, this comprises, consists essentially of, or consists of an initiation codon (ATG), a stop codon and a promoter, and optionally also a polyadenylation sequence for certain vectors such as plasmid and certain viral vectors, e.g., viral vectors other than poxviruses. When the polynucleotide encodes a polyprotein fragment, e.g. a BTV peptide, advantageously, in the vector, an ATG is placed at 5' of the reading frame and a stop codon is placed at 3'. Other elements for controlling expression may be present, such as enhancer sequences, stabilizing sequences, such as intron and signal sequences permitting the secretion of the protein.

The present invention also relates to preparations comprising vectors, such as expression vectors, e.g., therapeutic compositions. The preparations can comprise one or more vectors, e.g., expression vectors, such as in vivo expression vectors, comprising and expressing one or more BTV or AHSV polypeptides, antigens, epitopes or immunogens. In one embodiment, the vector contains and expresses a polynucleotide that comprises, consists essentially of, or consists of a polynucleotide coding for (and advantageously expressing) a BTV or AHSV antigen, epitope or immunogen, in a pharmaceutically or veterinarily acceptable carrier, excipient or vehicle. Thus, according to an embodiment of the invention, the other vector or vectors in the preparation comprises, consists essentially of or consists of a polynucleotide that encodes, and under appropriate circumstances the vector expresses one or more other proteins of a BTV polypeptide, antigen, epitope or immunogen, or a fragment thereof.

According to another embodiment, the vector or vectors in the preparation comprise, or consist essentially of, or consist of polynucleotide(s) encoding one or more proteins or fragment(s) thereof of a BTV or AHSV polypeptide, antigen, epitope or immunogen, the vector or vectors expressing the polynucleotide(s). In another embodiment, the preparation comprises one, two, or more vectors comprising polynucleotides encoding and expressing, advantageously in vivo, a BTV or AHSV polypeptide, antigen, fusion protein or an epitope thereof. The invention is also directed at mixtures of vectors that comprise polynucleotides encoding and expressing different BTV or AHSV polypeptides, antigens, epitopes or immunogens, e.g., a BTV or AHSV polypeptide, antigen, epitope or immunogen from different animal species such as, but not limited to, ovine, bovine, caprine or porcine According to a yet further embodiment of the invention, the expression vector is a plasmid vector or a DNA plasmid vector, in particular an in vivo expression vector. In a specific, non-limiting example, the pVR1020 or 1012 plasmid (VICAL Inc.; Luke et al., 1997; Hartikka et al., 1996, see, e.g., U.S. Pat. Nos. 5,846,946 and 6,451,769) can be utilized as a vector for the insertion of a polynucleotide sequence. The pVR1020 plasmid is derived from pVR1012 and contains the human tPA signal sequence. In one embodiment the human tPA signal comprises from amino acid M(1) to amino acid S(23) in Genbank under the accession number HUMTPA14. In another specific, non-limiting example, the plasmid utilized as a vector for the insertion of a polynucleotide sequence can contain the signal peptide sequence of equine IGF 1 from amino acid M(24) to amino acid A(48) in Genbank under the accession number U28070. Additional information on DNA plasmids which may be consulted or employed in the practice are found, for example, in U.S. Pat. Nos. 6,852,705; 6,818,628; 6,586,412; 6,576,243; 6,558,674; 6,464,984; 6,451,770; 6,376,473 and 6,221,362.

The term plasmid covers any DNA transcription unit comprising a polynucleotide according to the invention and the elements necessary for its in vivo expression in a cell or cells of the desired host or target; and, in this regard, it is noted that a supercoiled or non-supercoiled, circular plasmid, as well as a linear form, are intended to be within the scope of the invention.

Each plasmid comprises or contains or consists essentially of, in addition to the polynucleotide encoding a BTV or AHSV antigen, epitope or immunogen, optionally fused with a heterologous peptide sequence, variant, analog or fragment, operably linked to a promoter or under the control of a promoter or dependent upon a promoter. In general, it is advantageous to employ a strong promoter functional in eukaryotic cells. The strong promoter may be, but not limited to, the immediate early cytomegalovirus promoter (CMV-IE) of human or murine origin, or optionally having another origin such as the rat or guinea pig, the Super promoter (Ni, M. et al., Plant J. 7, 661-676, 1995). The CMV-IE promoter can comprise the actual promoter part, which may or may not be associated with the enhancer part. Reference can be made to EP-A-260 148, EP-A-323 597, U.S. Pat. Nos. 5,168,062, 5,385,839, and 4,968,615, as well as to PCT Application No WO87/03905. The CMV-IE promoter is advantageously a human CMV-IE (Boshart et al., 1985) or murine CMV-IE.

In more general terms, the promoter has either a viral, a plant, or a cellular origin. A strong viral promoter other than CMV-IE that may be usefully employed in the practice of the invention is the early/late promoter of the SV40 virus or the LTR promoter of the Rous sarcoma virus. A strong cellular promoter that may be usefully employed in the practice of the invention is the promoter of a gene of the cytoskeleton, such as e.g. the desmin promoter (Kwissa et al., 2000), or the actin promoter (Miyazaki et al., 1989).

Any of constitutive, regulatable, or stimulus-dependent promoters may be used. For example, constitutive promoters may include the mannopine synthase promoter from *Agrobacterium tumefaciens*. Alternatively, it may be advantageous to use heat shock gene promoters, drought-inducible gene promoters, pathogen-inducible gene promoters, wound-inducible gene promoters, and light/dark-inducible gene promoters. It may be useful to use promoters that are controlled by plant growth regulators, such as abscissic acid, auxins, cytokinins, and gibberellic acid. Promoters may also be chosen that give tissue-specific expression (e.g., root, leaf, and floral-specific promoters).

The plasmids may comprise other expression control elements. It is particularly advantageous to incorporate stabilizing sequence(s), e.g., intron sequence(s), for example, maize alcohol dehydrogenase intron (Callis et al. Genes & Dev. 1(10):1183-1200, December 1987), the first intron of the hCMV-IE (PCT Application No. WO1989/01036), the intron II of the rabbit β-globin gene (van Ooyen et al., 1979). In another embodiment, the plasmids may comprise 3' UTR. The 3' UTR may be, but not limited to, *agrobacterium* nopaline synthase (Nos) 3' UTR (Nopaline synthase: transcript mapping and DNA sequence. Depicker, A. et al. J. Mol. Appl. Genet., 1982; Bevan, NAR, 1984, 12(22): 8711-8721).

As to the polyadenylation signal (polyA) for the plasmids and viral vectors other than poxviruses, use can more be made of the poly(A) signal of the bovine growth hormone (bGH) gene (see U.S. Pat. No. 5,122,458), or the poly(A) signal of the rabbit β-globin gene or the poly(A) signal of the SV40 virus.

A "host cell" or "cell" denotes a prokaryotic or eukaryotic cell that has been genetically altered, or is capable of being genetically altered by administration of an exogenous polynucleotide, such as a recombinant plasmid or vector or ssRNA or dsRNA. When referring to genetically altered cells, the term refers both to the originally altered cell and to the progeny thereof.

In one embodiment, the subject matter disclosed herein is directed to a method of producing a recombinant BTV or AHSV vector comprising transfecting a cell with a) RNAs encoding one or more polypeptides of a serotype of BTV or AHSV; and b) RNAs comprising the transcripts of the entire genome of a different serotype of BTV or AHSV and comprises the deletion of the transcripts encoding the antigens in a).

In another embodiment, the subject matter disclosed herein is directed to a method of vaccinating an ovine, bovine, caprine, or porcine comprising administering to the ovine, bovine, caprine, or porcine an effective amount of a vaccine which may comprise an effective amount of a recombinant BTV vectors and a pharmaceutically or veterinarily acceptable carrier, excipient, or vehicle.

In an embodiment, the subject matter disclosed herein is directed to a method of eliciting an immune response comprising administering to the ovine, bovine, caprine, or porcine a vaccine comprising an ovine, bovine, caprine, or porcine recombinant BTV or AHSV vectors, wherein an immune response is elicited.

The administering may be subcutaneously or intramuscularly. The administering may be needle free (for example Pigjet or Bioject).

In one embodiment of the invention, a prime-boost regimen can be employed, which is comprised of at least one primary administration and at least one booster administration using at least one common polypeptide, antigen, epitope or immunogen. Typically the immunological composition or vaccine used in primary administration is different in nature from those used as a booster. However, it is noted that the same composition can be used as the primary administration and the boost. This administration protocol is called "prime-boost".

A prime-boost according to the present invention can include a recombinant viral vector is used to express a BTV coding sequence or fragments thereof encoding an antigenic polypeptide or fragment or variant thereof. Specifically, the viral vector can express a BTV or AHSV gene or fragment thereof that encodes an antigenic polypeptide. Viral vector contemplated herein includes, but not limited to, poxvirus [e.g., vaccinia virus or attenuated vaccinia virus, avipox virus or attenuated avipox virus (e.g., canarypox, fowlpox, dovepox, pigeonpox, quailpox, ALVAC, TROVAC; see e.g., U.S. Pat. No. 5,505,941, U.S. Pat. No. 5,494,8070), raccoonpox virus, swinepox virus, etc.], adenovirus (e.g., human adenovirus, canine adenovirus), herpesvirus (e.g. canine herpesvirus, herpesvirus of turkey, Marek's disease virus, infectious laryngotracheitis virus, feline herpesvirus, laryngotracheitis virus (ILTV), bovine herpesvirus, swine herpesvirus), baculovirus, retrovirus, etc. In another embodiment, the avipox expression vector may be a canarypox vector, such as, ALVAC. In yet another embodiment, the avipox expression vector may be a fowlpox vector, such as, TROVAC. The BTV or or AHSV antigen of the invention to be expressed is inserted under the control of a specific poxvirus promoter, e.g., the entomopoxvirus *Amsacta moorei* 42K promoter (Barcena, Lorenzo et al. 2000), the vaccinia promoter 7.5 kDa (Cochran et al., 1985), the vaccinia promoter I3L (Riviere et al., 1992), the vaccinia promoter HA (Shida, 1986), the cowpox promoter ATI (Funahashi et al., 1988), the vaccinia promoter H6 (Taylor et al., 1988b; Guo et al., 1989; Perkus et al., 1989), inter alia.

In another embodiment, the avipox expression vector may be a canarypox vector, such as, ALVAC. The BTV or AHSV polypeptide, antigen, epitope or immunogen may be a BTV or AHSV VP2 or BTV VP5. The viral vector may be vCP2289, which encodes BTV codon-optimized synthetic VP2 and VP5 (see US 2007/0280960).

In another aspect of the prime-boost protocol of the invention, a composition comprising the recombinant BTV vectors of the invention is administered followed by the administration of vaccine or composition comprising the BTV or AHSV antigen, or an inactivated viral vaccine, or a DNA plasmid vaccine or composition that contains or expresses the BTV or AHSV antigen. Likewise, a prime-boost protocol may comprise the administration of vaccine or composition comprising an inactivated viral vaccine, or composition comprising a BTV or AHSV antigen, or a DNA plasmid vaccine or composition that contains or expresses a BTV or AHSV antigen, followed by the administration of a composition comprising the recombinant BTV or AHSV vectors of the invention. It is further noted that both the primary and the secondary administrations may comprise the composition comprising the BTV antigen of the invention A prime-boost protocol comprises at least one prime-administration and at least one boost administration using at least one common polypeptide and/or variants or fragments thereof. The vaccine used in prime-administration may be different in nature from those used as a later booster vaccine. The prime-administration may comprise one or more administrations. Similarly, the boost administration may comprise one or more administrations.

The dose volume of compositions for target species that are mammals, e.g., the dose volume of ovine, bovine, caprine or porcine compositions, based on viral vectors, e.g., non-poxvirus-viral-vector-based compositions, is generally between about 0.1 to about 5.0 ml, between about 0.1 to about 3.0 ml, and between about 0.5 ml to about 2.5 ml.

The efficacy of the vaccines may be tested about 2 to 4 weeks after the last immunization by challenging animals, such as ovine, bovine, caprine or porcines, with a virulent strain of BTV, such as the BTV-1/2/3/4/8/9/16 or 17 strains. For example, the BTV strain may be serotype 17, which was originally isolated from the blood of sheep from Tulare County, CA (see Bonneau, DeMaula et al. 2002; DeMaula, Leutenegger et al. 2002). The BTV strain may also be serotype 8, an inactivated vaccine for which is currently available from Merial Limited.

Other strains may include BTV1 (isolate Australia), BTV1 (isolate South Africa), BTV2 (isolate USA), BTV3 (isolate South Africa), BTV4-9, BTV10 (isolate USA), BTV11 (isolate USA), BTV12, BTV13 (isolate USA), BTV14-17, BTV17 (isolate USA), BTV18, BTV19, BTV20 (isolate Australia), BTV21-24, or Corsican BTV.

Both homologous and heterologous strains are used for challenge to test the efficacy of the vaccine. The animal may be challenged intradermally, subcutaneously, spray, intra-nasally, intra-ocularly, intra-tracheally, and/or orally.

For BTV, bovines and caprines are evaluated for extensive vascular injury. Also for BTV, ovines are evaluated for catarrhal inflammation of the mucous membranes of the mouth, nose and forestomachs, inflammation of the coronary bands and laminae of the hoofs, excoriation of the epithelium, necrosis of the buccal mucosa, and swollen/inflamed/blue tongue and mouth. Swabs may be collected from all animals post challenge for virus isolation. The presence or absence of viral antigens in the above-indicated tissues may be evaluated by quantitative real time reverse transcriptase polymerase chain reaction (qRRT-PCR). Blood samples may be collected before and post-challenge and may be analyzed for the presence of anti-BTV specific antibody.

The prime-boost administrations may be advantageously carried out 2 to 6 weeks apart, for example, about 3 weeks apart. According to one embodiment, a semi-annual booster or an annual booster, advantageously using the viral vector-based vaccine, is also envisaged. The animals are advantageously at least 6 to 8 weeks old at the time of the first administration.

The compositions comprising the recombinant antigenic polypeptides of the invention used in the prime-boost protocols are contained in a pharmaceutically or veterinary acceptable vehicle, diluent or excipient. The protocols of the invention protect the animal from ovine, bovine, caprine or porcine BTV or AHSV and/or prevent disease progression in an infected animal The various administrations are preferably carried out 1 to 6 weeks apart, and more particularly about 3 weeks apart. According to a preferred mode, an annual booster, preferably using the viral vector-based immunological composition of vaccine, is also envisaged. The animals are preferably at least one-day-old at the time of the first administration.

It should be understood by one of skill in the art that the disclosure herein is provided by way of example and the present invention is not limited thereto. From the disclosure herein and the knowledge in the art, the skilled artisan can determine the number of administrations, the administration route, and the doses to be used for each injection protocol, without any undue experimentation.

The present invention contemplates at least one administration to an animal of an efficient amount of the therapeutic composition made according to the invention. The animal may be male, female, pregnant female and newborn. This administration may be via various routes including, but not limited to, intramuscular (IM), intradermal (ID) or subcutaneous (SC) injection or via intranasal or oral administration. The therapeutic composition according to the invention can also be administered by a needleless apparatus (as, for example with a Pigjet, Dermojet, Biojector, Avijet (Merial, Ga., USA), Vet et or Vitajet apparatus (Bioject, Oregon, USA)). Another approach to administering plasmid compositions is to use electroporation (see, e.g. Tollefsen et al., 2002; Tollefsen et al., 2003; Babiuk et al., 2002; PCT Application No. WO99/01158). In another embodiment, the therapeutic composition is delivered to the animal by gene gun or gold particle bombardment.

In one embodiment, the invention provides for the administration of a therapeutically effective amount of a formulation for the delivery and expression of a BTV or AHSV antigen or epitope in a target cell. Determination of the therapeutically effective amount is routine experimentation for one of ordinary skill in the art. In one embodiment, the formulation comprises an expression vector comprising a polynucleotide that expresses a BTV or AHSV antigen or epitope and a pharmaceutically or veterinarily acceptable carrier, vehicle or excipient. In another embodiment, the pharmaceutically or veterinarily acceptable carrier, vehicle or excipient facilitates transfection or other means of transfer of polynucleotides to a host animal and/or improves preservation of the vector or protein in a host.

In one embodiment, the subject matter disclosed herein provides a detection method for differentiation between infected and vaccinated animals (DIVA).

Currently, there are several available BTV vaccines. Merial and Intervet both offer inactivated BTV8 vaccines. A method to distinguish between BTV-vaccinated and BTV-infected animals has recently been described (Silvia C. Barros et al., Veterinary-Microbiology, 2009).

It is disclosed herein that the use of the vaccine or composition of the present invention allows the detection of BTV or AHSV infection in an animal. It is disclosed herein that the use of the vaccine or composition of the present invention allows the detection of the infection in animals by differentiating between infected and vaccinated animals (DIVA). A method is disclosed herein for diagnosing the infection of BTV in an animal using BTV-NS3-based immunogenic detection method, such as, NS3-specific ELISA.

Article of Manufacture

In an embodiment, the subject matter disclosed herein is directed to a kit for performing a method of eliciting or inducing an immune response which may comprise any one of the recombinant BTV or AHSV immunological compositions or vaccines, or inactivated BTV or AHSV immunological compositions or vaccines, recombinant BTV or AHSV viral compositions or vaccines, and instructions for performing the method.

Another embodiment of the invention is a kit for performing a method of inducing an immunological or protective response against BTV or AHSV in an animal comprising a composition or vaccine comprising a BTV antigen of the invention and a recombinant BTV or AHSV viral immunological composition or vaccine, and instructions for performing the method of delivery in an effective amount for eliciting an immune response in the animal.

Another embodiment of the invention is a kit for performing a method of inducing an immunological or protective response against BTV or AHSV in an animal comprising a composition or vaccine comprising a BTV or AHSV antigen of the invention and an inactivated BTV immunological composition or vaccine, and instructions for performing the method of delivery in an effective amount for eliciting an immune response in the animal.

Yet another aspect of the present invention relates to a kit for prime-boost vaccination according to the present invention as described above. The kit may comprise at least two vials: a first vial containing a vaccine or composition for the prime-vaccination according to the present invention, and a second vial containing a vaccine or composition for the boost-vaccination according to the present invention. The kit may advantageously contain additional first or second vials for additional prime-vaccinations or additional boost-vaccinations.

The following embodiments are encompassed by the invention. In an embodiment, a composition comprising a recombinant BTV or AHSV vector and a pharmaceutical or veterinarily acceptable carrier, excipient, adjuvant, or vehicle is disclosed. In an embodiment, the above compositions wherein the pharmaceutical or veterinarily acceptable carrier, excipient, adjuvant, or vehicle is a water-in-oil emulsion or an oil-in-water emulsion are disclosed. In another embodiment, a method of vaccinating an animal susceptible to ovine, bovine, caprine, or porcine BTV or AHSV comprising administering the compositions above to the animal is disclosed. In an embodiment, a method of vaccinating an animal susceptible to ovine, bovine, caprine, or porcine BTV or AHSV comprising a prime-boost regime is disclosed. In one embodiment, a method of diagnosing influenza infection in an animal is disclosed. In yet another embodiment, a kit for prime-boost vaccination comprising at least two vials, wherein a first vial containing the composition of the present invention, and a second vial containing a composition for the boost-vaccination comprising a composition comprising a recombinant viral vector, or a composition comprising an inactivated viral composition, or a DNA plasmid composition that contains or expresses the BTV or AHSV antigen is disclosed.

The pharmaceutically or veterinarily acceptable carriers or vehicles or adjuvants or excipients are well known to the one skilled in the art. For example, a pharmaceutically or veterinarily acceptable carrier or vehicle or excipient can be a 0.9% NaCl (e.g., saline) solution or a phosphate buffer. Other pharmaceutically or veterinarily acceptable carrier or vehicle or excipients that can be used for methods of this invention include, but are not limited to, poly-(L-glutamate) or polyvinylpyrrolidone. The pharmaceutically or veterinarily acceptable carrier or vehicle or excipients may be any compound or combination of compounds facilitating the administration of the vector (or protein expressed from an inventive vector in vitro); advantageously, the carrier, vehicle or excipient may facilitate transfection and/or improve preservation of the vector (or protein). Doses and dose volumes are herein discussed in the general description and can also be determined by the skilled artisan from this disclosure read in conjunction with the knowledge in the art, without any undue experimentation.

The cationic lipids containing a quaternary ammonium salt which are advantageously but not exclusively suitable for plasmids, are advantageously those having the following formula:

$$R_1-O-CH_2-CH-CH_2-\overset{\overset{CH_3}{|}+}{\underset{\underset{CH_3}{|}}{N}}-R_2-X$$
$$\phantom{R_1-O-CH_2-}\underset{OR_1}{|}$$

in which R1 is a saturated or unsaturated straight-chain aliphatic radical having 12 to 18 carbon atoms, R2 is another aliphatic radical containing 2 or 3 carbon atoms and X is an amine or hydroxyl group, e.g. the DMRIE. In another embodiment the cationic lipid can be associated with a neutral lipid, e.g. the DOPE.

Among these cationic lipids, preference is given to DMRIE (N-(2-hydroxyethyl)-N,N-dimethyl-2,3-bis(tetradecyloxy)-1-propane ammonium; WO96/34109), advantageously associated with a neutral lipid, advantageously DOPE (dioleoyl-phosphatidyl-ethanol amine; Behr, 1994), to form DMRIE-DOPE.

Advantageously, the plasmid mixture with the adjuvant is formed extemporaneously and advantageously contemporaneously with administration of the preparation or shortly before administration of the preparation; for instance, shortly before or prior to administration, the plasmid-adjuvant mixture is formed, advantageously so as to give enough time prior to administration for the mixture to form a complex, e.g. between about 10 and about 60 minutes prior to administration, such as approximately 30 minutes prior to administration.

When DOPE is present, the DMRIE:DOPE molar ratio is advantageously about 95:about 5 to about 5:about 95, more advantageously about 1:about 1, e.g., 1:1.

The DMRIE or DMRIE-DOPE adjuvant:plasmid weight ratio can be between about 50:about 1 and about 1:about 10, such as about 10:about 1 and about 1:about 5, and about 1:about 1 and about 1:about 2, e.g., 1:1 and 1:2.

In another embodiment, pharmaceutically or veterinarily acceptable carrier, excipient, vehicle or adjuvant may be a water-in-oil emulsion. Examples of suitable water-in-oil emulsions include oil-based water-in-oil vaccinal emulsions which are stable and fluid at 4° C. containing: from 6 to 50 v/v % of an antigen-containing aqueous phase, preferably from 12 to 25 v/v %, from 50 to 94 v/v % of an oil phase containing in total or in part a non-metabolizable oil (e.g., mineral oil such as paraffin oil) and/or metabolizable oil (e.g., vegetable oil, or fatty acid, polyol or alcohol esters), from 0.2 to 20 p/v % of surfactants, preferably from 3 to 8 p/v %, the latter being in total or in part, or in a mixture either polyglycerol esters, said polyglycerol esters being preferably polyglycerol (poly)ricinoleates, or polyoxyethylene ricin oils or else hydrogenated polyoxyethylene ricin oils. Examples of surfactants that may be used in a water-in-oil emulsion include ethoxylated sorbitan esters (e.g., polyoxyethylene (20) sorbitan monooleate (TWEEN 80®), available from AppliChem, Inc., Cheshire, Conn.) and sorbitan esters (e.g., sorbitan monooleate (SPAN 80®), available from Sigma Aldrich, St. Louis, Mo.). In addition, with respect to a water-in-oil emulsion, see also U.S. Pat. No. 6,919,084, e.g., Example 8 thereof, incorporated herein by reference. In some embodiments, the antigen-containing aqueous phase comprises a saline solution comprising one or more buffering agents. An example of a suitable buffering solution is phosphate buffered saline. In an advantageous embodiment, the water-in-oil emulsion may be a water/oil/water (W/O/W) triple emulsion (U.S. Pat. No. 6,358,500). Examples of other suitable emulsions are described in U.S. Pat. No. 7,371,395.

The immunological compositions and vaccines according to the invention may comprise or consist essentially of one or more pharmaceutically or veterinarily acceptable carrier, excipient, vehicle, or adjuvants. Suitable carriers or adjuvants for use in the practice of the present invention are (1) polymers of acrylic or methacrylic acid, maleic anhydride and alkenyl derivative polymers, (2) immunostimulating sequences (ISS), such as oligodeoxyribonucleotide sequences having one or more non-methylated CpG units (Klinman et al., 1996; WO98/16247), (3) an oil in water emulsion, such as the SPT emulsion described on page 147 of "Vaccine Design, The Subunit and Adjuvant Approach" published by M. Powell, M. Newman, Plenum Press 1995, and the emulsion MF59 described on page 183 of the same work, (4) cation lipids containing a quaternary ammonium salt, e.g., DDA (5) cytokines, (6) aluminum hydroxide or aluminum phosphate, (7) saponin or (8) other adjuvants discussed in any document cited and incorporated by reference into the instant application, or (9) any combinations or mixtures thereof.

The oil in water emulsion (3), which is especially appropriate for viral vectors, can be based on: light liquid paraffin oil (European pharmacopoeia type), isoprenoid oil such as squalane, squalene, oil resulting from the oligomerization of alkenes, e.g. isobutene or decene, esters of acids or alcohols having a straight-chain alkyl group, such as vegetable oils, ethyl oleate, propylene glycol, di(caprylate/caprate), glycerol tri(caprylate/caprate) and propylene glycol dioleate, or esters of branched, fatty alcohols or acids, especially isostearic acid esters.

The oil is used in combination with emulsifiers to form an emulsion. The emulsifiers may be nonionic surfactants, such as: esters of on the one hand sorbitan, mannide (e.g. anhydromannitol oleate), glycerol, polyglycerol or propylene glycol and on the other hand oleic, isostearic, ricinoleic or hydroxystearic acids, said esters being optionally ethoxylated, or polyoxypropylene-polyoxyethylene copolymer blocks, such as Pluronic, e.g., L121.

Among the type (1) adjuvant polymers, preference is given to polymers of crosslinked acrylic or methacrylic acid, especially crosslinked by polyalkenyl ethers of sugars or polyalcohols. These compounds are known under the name carbomer (Pharmeuropa, vol. 8, no. 2, June 1996). One skilled in the art can also refer to U.S. Pat. No. 2,909,462, which provides such acrylic polymers crosslinked by a polyhydroxyl compound having at least three hydroxyl groups, preferably no more than eight such groups, the hydrogen atoms of at least three hydroxyl groups being replaced by unsaturated, aliphatic radicals having at least two carbon atoms. The preferred radicals are those containing 2 to 4 carbon atoms, e.g. vinyls, allyls and other ethylenically unsaturated groups. The unsaturated radicals can also contain other substituents, such as methyl. Products sold under the name Carbopol (BF Goodrich, Ohio, USA) are especially suitable. They are crosslinked by allyl saccharose or by allyl pentaerythritol. Among them, reference is made to Carbopol 974P, 934P and 971P.

As to the maleic anhydride-alkenyl derivative copolymers, preference is given to EMA (Monsanto), which are straight-chain or crosslinked ethylene-maleic anhydride copolymers and they are, for example, crosslinked by divinyl ether. Reference is also made to J. Fields et al., 1960.

With regard to structure, the acrylic or methacrylic acid polymers and EMA are preferably formed by basic units having the following formula:

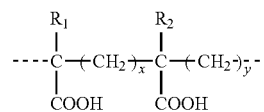

in which:
R1 and R2, which can be the same or different, represent H or CH3
x=0 or 1, preferably x=1
y=1 or 2, with x+y=2.
For EMA, x=0 and y=2 and for carbomers x=y=1.

These polymers are soluble in water or physiological salt solution (20 g/l NaCl) and the pH can be adjusted to 7.3 to 7.4, e.g., by soda (NaOH), to provide the adjuvant solution in which the expression vector(s) can be incorporated. The polymer concentration in the final immunological or vaccine composition can range between about 0.01 to about 1.5% w/v, about 0.05 to about 1% w/v, and about 0.1 to about 0.4% w/v.

The cytokine or cytokines (5) can be in protein form in the immunological or vaccine composition, or can be co-expressed in the host with the immunogen or immunogens or epitope(s) thereof. Preference is given to the co-expression of the cytokine or cytokines, either by the same vector as that expressing the immunogen or immunogens or epitope(s) thereof, or by a separate vector thereof.

The invention comprehends preparing such combination compositions; for instance by admixing the active components, advantageously together and with an adjuvant, carrier, cytokine, and/or diluent.

Cytokines that may be used in the present invention include, but are not limited to, granulocyte colony stimulating factor (G-CSF), granulocyte/macrophage colony stimulating factor (GM-CSF), interferon α (IFNα), interferon β (IFNβ), interferon γ, (IFNγ), interleukin-1α (IL-1α), interleukin-1β (IL-1β), interleukin-2 (IL-2), interleukin-3 (IL-3), interleukin-4 (IL-4), interleukin-5 (IL-5), interleukin-6 (IL-6), interleukin-7 (IL-7), interleukin-8 (IL-8), interleukin-9 (IL-9), interleukin-10 (IL-10), interleukin-11 (IL-11), interleukin-12 (IL-12), tumor necrosis factor α (TNFα), tumor necrosis factor β (TNFβ), and transforming growth factor β (TGFβ). It is understood that cytokines can be co-administered and/or sequentially administered with the immunological or vaccine composition of the present invention. Thus, for instance, the vaccine of the instant invention can also contain an exogenous nucleic acid molecule that expresses in vivo a suitable cytokine, e.g., a cytokine matched to this host to be vaccinated or in which an immunological response is to be elicited (for instance, a bovine cytokine for preparations to be administered to bovines).

Advantageously, the immunological composition and/or vaccine according to the invention comprise or consist essentially of or consist of an effective quantity to elicit a therapeutic response of one or more polypeptides as discussed herein; and, an effective quantity can be determined from this disclosure, including the documents incorporated herein, and the knowledge in the art, without undue experimentation.

In the case of immunological composition and/or vaccine based on the expressed polypeptides, a dose may include, about in 1 µg to about 2000 µg, advantageously about 50 µg to about 1000 µg and more advantageously from about 100 µg to about 500 µg of BTV or FMDV antigen, epitope or immunogen. The dose volumes can be between about 0.1 and about 10 ml, advantageously between about 0.2 and about 5 ml.

The invention will now be further described by way of the following non-limiting examples.

EXAMPLES

Construction of DNA inserts, plasmids and recombinant viral or plant vectors was carried out using the standard molecular biology techniques described by J. Sambrook et al. (Molecular Cloning: A Laboratory Manual, 2nd Edition, Cold Spring Harbor Laboratory, Cold Spring Harbor, N.Y., 1989).

Example 1 Generation of Reassortant BTV

Cells and Viruses

BSR cells are a clone of BHK-21 cells and were maintained in Dulbecco's modified Eagle's medium (DMEM, Gibco) supplemented with 5% foetal bovine serum (FBS) and 25 µg/ml penicillin/streptomycin (p/s, Gibco). Vero cells were maintained in DMEM supplemented with 5% FBS and p/s. CPT-Tert cells are an immortalised line of sheep choroid plexus cells (59) and were maintained in Iscove's modified Dulbecco's medium (IMDM, Gibco) supplemented with 10% FBS and p/s. All mammalian cells were incubated at 37° C. in a humidified incubator with 5% $CO_2$.

BTV-1 is the South African serotype 1 reference strain and has been used as the basis for the first BTV reverse genetics system. The European BTV-8 strain (BTV-8NET2008/06 (IAH Orbivirus collection)) was isolated from a clinically affected cow in the Netherlands, and has a passage history of just a single passage in KC cells followed by one further passage in BHK-21 cells.

Plasmids

The plasmids used for the rescue of BTV-1 and BTV-8 were described previously (Ratinier et al, 2011). Each plasmid contains a single BTV cDNA copy of a genomic segment flanked by a 5' T7 promoter and a 3' restriction site. Both the T7 promoter and restriction site were arranged such that plasmids linearized with the appropriate restriction enzyme allowed the in vitro transcription of capped RNA transcripts with authentic BTV termini. Additional plasmids containing Seg-2 of virulent field isolates of BTV-2, BTV-4 and BTV-9 (13) in the same context as the other rescue plasmids were synthesized commercially (GenScript).

Reverse Genetics

Plasmids containing the genomic segments of BTV-1 or BTV-8 or resulting mutants were linearized with the appropriate restriction enzymes and then purified by phenol-chloroform extraction. Digested plasmids were used as a template for in vitro transcription using the mMESSAGE mMACHINE T7 Ultra. Kit (Ambion), according to the manufacturer's instructions. ssRNAs were purified sequentially by phenol/chloroform extraction and through Illustra Microspin G25 columns (GE Healthcare Life Sciences), following the manufacturer's protocol.

Combinations of the individual RNAs were assembled according to the reassortants desired (see Table 1 and FIG. 1).

$2 \times 10^5$ BSR cells were plated in 12 well plates in growth medium without antibiotics, 24 h prior to transfection. The cells were transfected twice with RNA using Lipofectamine 2000. For the first transfection, $1 \times 10^{11}$ copies of in vitro transcribed BTV-like capped RNA encoding VP1, 3, 4, 6, NS1 and NS2 were mixed with OptiMEM (Gibco) containing RNAsin Plus (0.5 U/µl, Promega) in a final volume of 10 µl. 2 µl of Liptofectamine 2000 was mixed with 10 µl of OptiMEM (with RNAsin Plus) and incubated for 5 min prior to combining with the RNA. Transfection complexes were allowed to form for 20 min before the transfection mixture was added dropwise to the cells. Approximately 18 h after the first transfection, the media was replaced and the cells transfected a second time as per the first transfection, but with all 10 segments and 3 µl Lipofectamine. 4 h after the second transfection, the medium was replaced with an agar overlay.

A standard nomenclature is adopted throughout this report: the upper case section of the name refers to the backbone of the virus, followed by a subscript comprising the protein substituted, preceded by the serotype origin of the segment, for example BTV-$1_{8VP1}$ refers to a virus with a BTV-1 backbone containing the VP1 gene of BTV-8.

The schematic graph depicting the generation of reassortant BTV is shown in FIG. 6.

Growth Curves

For the analysis of virus growth in vitro, $2 \times 10^5$ CPT-Tert cells/well or $3 \times 10^6$ KC cells/well were plated in 12 well plates in 1 ml of growth media the day prior to infection. Cells were incubated in the media containing the relevant virus for 2 h at 37° C. Media was then discarded and cells washed once with DMEM and then incubated with 1 ml of appropriate fresh growth media. 100 μl samples of the supernatant were removed at 0, 8, 24, 48 and 72 hours post infection (p.i.), and replaced with 100 μl fresh growth media. 100 μl samples were clarified by centrifugation for 5 minutes at 500×g and then stored at 4° C. Samples were then titrated by limiting dilution assays (60) in BSR cells and virus titres expressed as $TCID_{50}$/ml.

Plaque Assays

CPT-Tert cells were seeded at a density of $4×10^5$ cells/well in 6 well plates 24 h prior to infection with BTV. Cells were infected for 2 h at 37° C. Afterwards, media containing the virus was discarded and cells were washed with DMEM and incubated for 72 h in 3 ml of a semi-solid overlay (1.2% Avicel in DMEM supplemented with 4% FBS and p/s). The overlay was then discarded and cells washed with PBS and then stained for >1 h with crystal violet in formaldehyde.

Neutralization Assays

Three-fold serial dilutions of BTV-1 or BTV-8 specific antisera were prepared in quadruplicate in 96-well plates using 50 μl of each test serum diluted in DMEM containing 3% FBS. 100 $TCID_{50}$ of BTV-1, BTV-8 and selected reassortants were then added to the corresponding wells and plates and incubated at 37° C. for 1 h. Finally, $2.5×10^4$ Vero cells were added to each well and the plate incubated at 37° C. for 5 days in a humidified incubator with 5% $CO_2$ whereupon viral CPE was visually assessed. The protective dose 50 ($PD_{50}$) for each serum sample, defined as the serum dilution that inhibits BTV infection in 50% of Vero cell cultures, was then determined using the Reed-Muench method (60). The suspension BHK-21 cells were scaled up for large scale production of reassortant BTV. The harvested reassortant BTV were inactivated. Suitable adjuvants were added to the ressaortant BTV for vaccine preparation.

Results

Reverse genetics was used to determine whether it was possible to reassort any individual segment of either BTV-1 or BTV-8 into an alternative backbone. All combinations of virus with a single segment of BTV-8 in the backbone of BTV-1 were successfully rescued, and vice versa (FIG. 1). The genotype of each reassortant virus was checked by amplification by RT-PCR and sequencing of a fragment from each segment (FIG. 1). The results showed that any BTV segment can reassort between BTV-1 and BTV-8.

Figure 2:
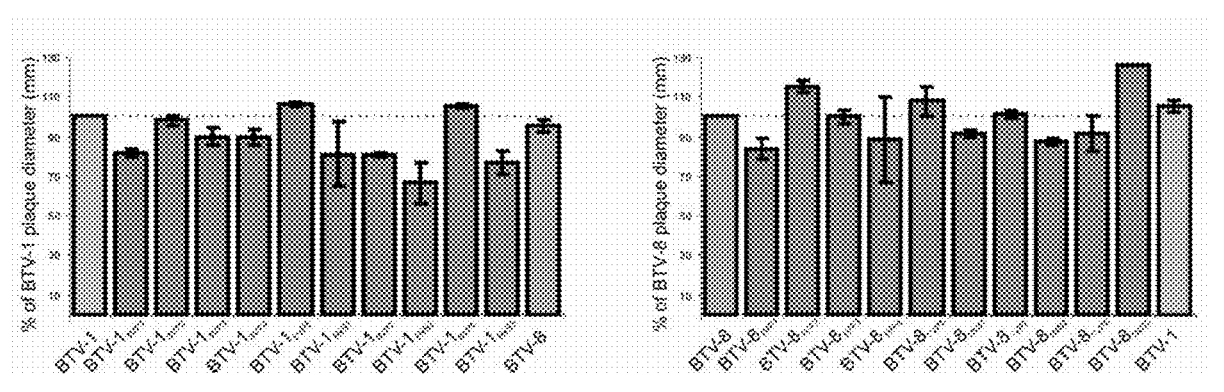

The in vitro growth characteristics of every reassortant virus was assessed using both plaque assay and by performing virus growth curves. Average plaque diameters were determined from two independent rounds of plaque assay. In the majority of cases, plaque diameter was largely unaffected and differed little from the parental backbone into which the alternative individual segment was inserted (FIG. 2A-B). However, some viruses consistently revealed a smaller or larger plaque phenotype relative to the parental backbone. The substitution of the BTV-8 Seg-8 (encoding NS2) into the BTV-1 backbone (BTV-$1_{8NS2}$) resulted in plaques that were approximately 33% smaller than wild-type BTV-1 (FIG. 2A). The plaques of the opposite reassortant, i.e. BTV-$8_{1NS2}$, were also reduced, although to a lesser extent (FIG. 2B). Other monoreassortants that consistently yielded plaques with a smaller diameter compared to the parental viruses were those with reassorted segments encoding VP1, VP4, and NS1.

Growth curve analyses were performed in order to assess the growth kinetics of each reassortant. The majority of the reassortants demonstrated growth dynamics similar to the corresponding wild-type viruses (FIG. 3).

Several studies have suggested that VP2 is inextricably linked to BTV serotype. However, it has also been suggested that VP5 contributes to defining a serotype for particular strains. To investigate the relative contributions of VP2 and VP5 to serotype determination, serum neutralization assays were performed using reassortants BTV-1, BTV-8 and reassortants with the backbone of either BTV-1 or BTV-8 and the heterologous VP2 alone or VP2 and VP5 (BTV-$1_{8VP2}$, BTV-$1_{8VP2,VP5}$, BTV-$8_{1VP2}$ and BTV-$8_{1VP2,VP5}$). BTV-1 and BTV-8 neutralizing antisera were derived from animals vaccinated against BTV-1 or BTV-8 and challeneged with the homologous strain.

The results showed that BTV-8 antisera completely neutralized wild-type BTV-8, whilst showing no neutralizing capacity against BTV-1 (FIG. 4A). Similarly BTV-1 was neutralized by BTV-1 antisera but not by BTV-8 antisera (FIG. 4A).

Experiments with reassortants containing VP2 alone or VP2 and VP5 of the heterologous virus revealed that the virus is only neutralized when the sera matches the VP2 protein, confirming studies linking serotype solely with VP2.

The results indicating that VP2 alone can dictate serotype prompted us to generate further BTV-1 reassortants incorporating Seg-2 from a selection of serotypes. BTV-1 reassortant viruses containing the VP2 of BTV-2, BTV-4 and BTV-9, resulting in BTV-$1_{2VP2}$, BTV-$1_{4VP2}$ and BTV-$1_{9VP2}$ respectively were successfully rescued. In all cases viruses were rescued which grew equally to the wild-type virus (FIG. 5).

Example 2 Clinical and Serology Study of Vaccinated Animals

Two constructs using a BTV-1 backbone and replacing (VP2BTV1) or (VP2BTV1+VP5BTV1) with (VP2BTV8) or (VP2BTV8+VP5BTV8) respectively were used in the challenge study. Characteristics of the antigens produced to formulate the tested vaccines are summarized in Table 2 below.

TABLE 2

| Characteristics of the antigens | | |
| --- | --- | --- |
| antigen | backbone | Protein(s) replace (and serotype) |
| VP2 | BTV-1 | VP2 (BTV-8) |
| VP2 + VP5 | BTV-1 | VP2 (BTV-8) + VP5 (BTV-8) |

The reassortant viruses were grown, inactivated and processed to produce two antigen batches. These antigens were formulated into vaccines by blending them with Aluminium gel (2.7 mg aluminium hydroxide) and saponin (30HU saponin per 1 mL vaccine dose) as adjuvants. The vaccines tested are listed in Table 3.

TABLE 3

Characteristics of the vaccines

| antigen | VP2 antigen content Per 1 mL vaccine dose (Log10pixel*) | Volumetric Antigen content Per 1 mL vaccine dose (mL**) |
|---|---|---|
| VP2 high dose | 3.2 | 6.39 |
| VP2 low dose | 2.12 | 0.53 |
| VP2 + VP5 | 3.2 | 6.49 |

*VP2$_{BTV8}$ content measured by quantitative Dot Blot on the AI (Active Ingredient)
**Equivalent mL of non-concentrated AI The vaccines were administered in 1 or 2 injections to conventional BTV sero-negative sheep. Protection was assessed through a virulent BTV-8 challenge performed 21 days following completion of the vaccination and subsequent clinical and virological monitoring. Challenge study in sheep was carried out according to the Table 4 below.

TABLE 4

| Group | treatment | vaccination | | effective | Challenge with BTV-8 on D42 |
|---|---|---|---|---|---|
| | | D0 | D21 | 5 | yes |
| G1 | VP2 high dose | x | x | 5 | yes |
| G2 | VP2 high dose | — | x | 5 | yes |
| G3 | VP2 low dose | — | x | 5 | yes |
| G4 | VP2 + VP5 | x | x | 5 | yes |
| G5 | VP2 + VP5 | — | x | 5 | yes |
| G6 | Commercial BTV-8 vaccine (Merial)-positive control | — | x | 5 | yes |
| G7 | Negative control | — | — | 6 | yes |

Before the vaccination sessions, all animals were monitored for their health status and for rectal temperature. On D0 and/or D21, each animal from groups G1 to G6 received one dose of 1 mL of the appropriate vaccine, as described in Table 4. Injections were performed by sub-cutaneous route on the left (D0) or right (D21) lateral face of the thorax, beside the elbow, after local disinfection of the injection site. The animals from the group G7 remained untreated and served as controls.

For all animals, rectal temperature was recorded on D42 (before challenge) and then daily from D47 to D56. From D47 to D56, general behavior and body condition of all animals were recorded. For General condition: Good is assigned a score of 0; Apathic is assigned a score of 1; Depressed is assigned a score of 2; Prostrated is assigned a score of 3. For Body condition: Normal is assigned a score of 0; Thin is assigned a score of 1; Cachectic is assigned a score of 2.

From D47 to D56, clinical signs frequently observed during Bluetongue infection were recorded, including:
  Congestion and/or oedema, especially on the head: eyes, nostrils, ears, lips, chamfer, intermandibular space
  Hypersalivation
  Nasal discharge/crusts
  Plaintive bleating
  Petechias
  Loconotion troubles (lameness)
  Respiratory troubles (cough/dyspnoea)
  Digestive troubles (diarrhea)
  Erythema
Other clinical sign was recorded when present. On the days where no individual clinical monitoring was performed, general health condition of the herd was checked daily as part of daily care and maintenance.

On D0 (before vaccination), D21 (before vaccination), D42 (before challenge) and D56, all sheep were blood sampled by jugular puncture with plain tubes. All samples were treated to collect serum. Sera were aliquoted and heat inactivated (56° C., 30 min) before their transfer to the Clinical Analysis Laboratory. BTV-8 specific antibody titres were determined in individual sera at all date of sampling by seroneutralisation tests.

Sero-neutralization tests were performed according to the technique (N° 002488) currently used by the Clinical Analysis Laboratory. Briefly, sera were tested in three-fold dilutions (0.48 Log 10), starting at ⅓, in microtitre plates. Hundred microlitres of diluted serum were incubated 1 hour at 37° C. with 50 microlitres of a viral suspension of a given BTV serotype (serotype 8). Fifty microlitres of a VERO cell suspension containing 500 000 cells per ml were then added to the mixture and plates were incubated at 37° C. Reading of the plates was based on cytopathic effect, after a 7-day incubation. Serum titres, expressed in Log 10 (PD50%) were calculated by regression after angular transformation.

On D42 (before challenge), D47, D49, D51, D54 and D56, all sheep were blood sampled by jugular puncture with EDTA tubes.

In order to detect and quantify Bluetongue virus RNA in blood, analysis by qRT-PCR test was performed on these samples. These assays were done according to Technique No. 200336 currently used by the Clinical Analysis Laboratory (automated method).

Briefly, after extraction using a commercial kit (Nucleospin multi 96), RNA was first denatured by heat treatment. One aliquot was then incubated with MGB probe, specific primers and reagent from the Invitrogen Super Script III Platinium One step kit, to allow amplification in the thermocyclor. This step was performed in duplicates. The fluorescent signal is proportional to the quantity of DNA synthesized. Amplification concerns any of the 24 BTV serotypes. Quantification of BTV nucleic acids in the samples was made by comparison to standardized RNA samples. The amount of RNA was expressed in Log 10 number of RNA copies per mL of blood considering the results obtained on each duplicate when both were positive and only the positive one when one of the duplicates was found negative. The positive cut off point 95% of the technique (defined as the minimum number of target sequences per volume sample that can be detected in 95% of test runs) or positive response threshold 95% (PRT95) was determined at 3.68 log 10 RNA copies/mL. Results of samples titrating below 3.68 log 10 RNA copies/mL were expressed as <PRT95 and were considered negative. Results of samples titrating ≥P RT95 were given such and were considered positive.

For the purpose of results description (calculation of mean, standard deviation and area under the curve) and analysis, a titre of 3.68 log 10 RNA copies/mL was attributed to negative samples.

Hyperthermia Results

Figure 9:
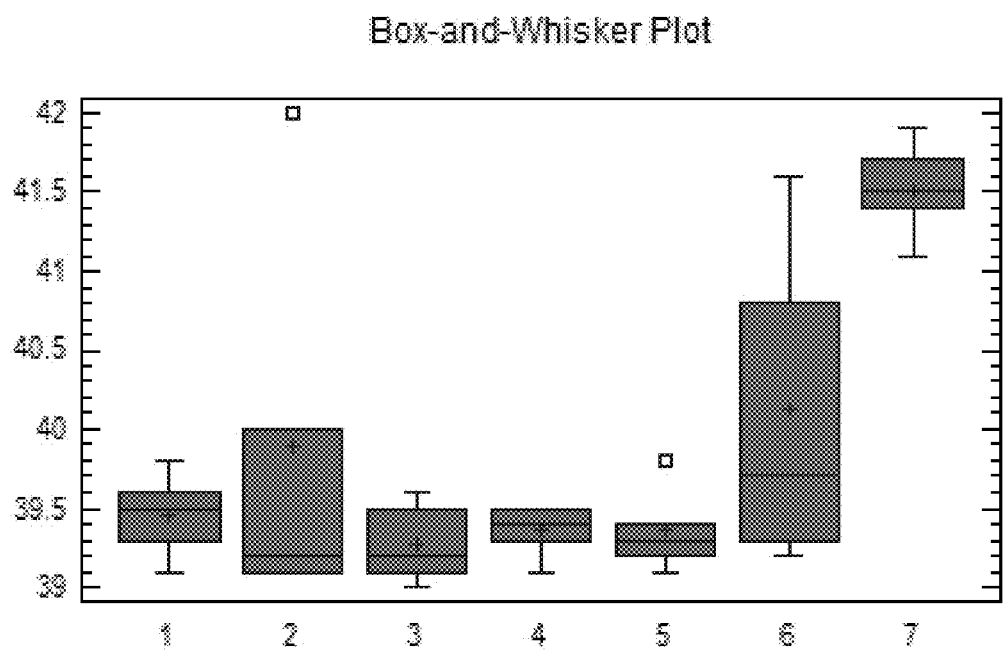
FIG. 9 depicts dispersions of maximal hyperthermias.

Evolutions of average temperatures after challenge are shown in FIG. 8. Dispersions of Maximal Hyperthermias are shown in FIG. 9.

An increase of rectal temperature was clearly observed in the control group, starting at D48 (i.e. 6 days after challenge) and peaking on D49 (41.3° C. on average), then progressively reducing up to D56.

In all vaccinated groups, the average temperature was rather constant throughout the monitoring period. When compared to the control group (G7), maximal hyperthermias were statistically significantly (p≤0.01) reduced in the vaccinated groups G1, G3 and G4. The differences were not statistically significant for G2 and G6.

Clinical Signs and Clinical Scores

Figure 10:
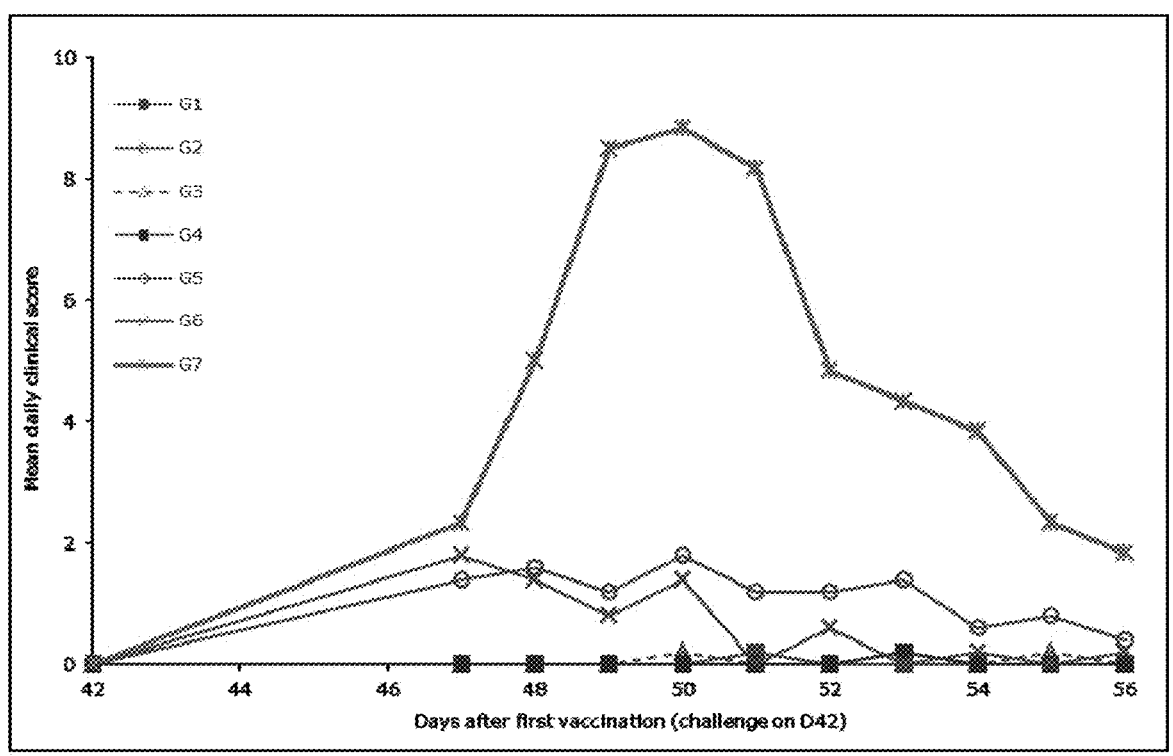
FIG. 10 depicts the evolution of mean daily clinical scores.
Figure 11:
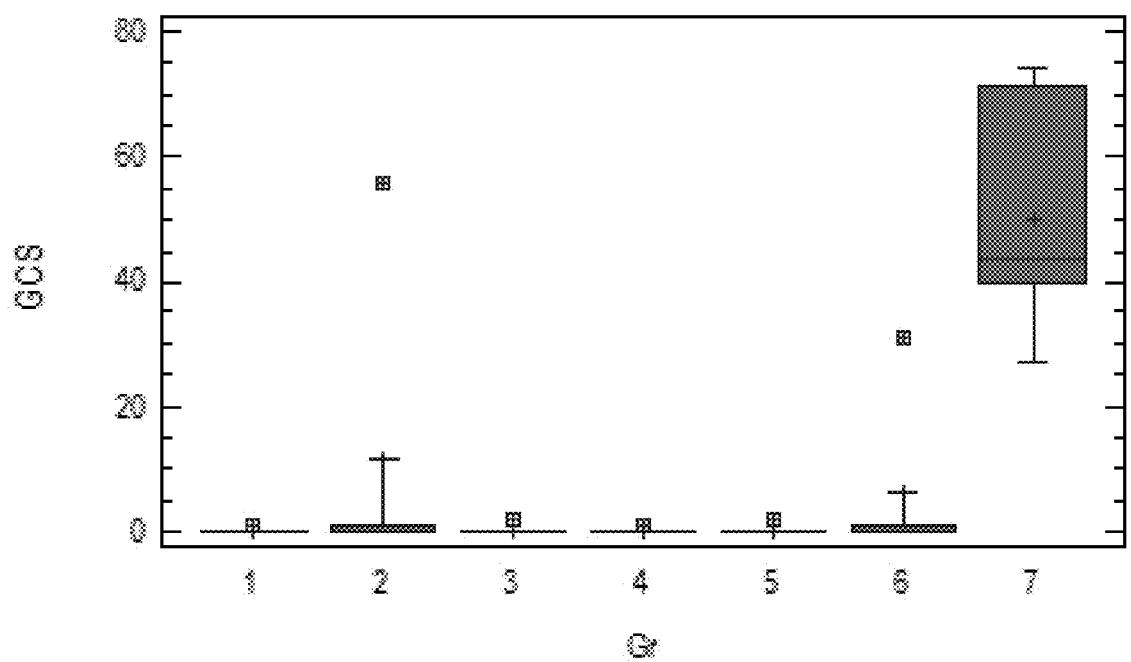
FIG. 11 depicts dispersions of global clinical scores.

Evolution of mean daily clinical scores is shown in FIG. 10. Dispersion of GCS per group is depicted in FIG. 11.

After challenge, the most frequently observed clinical signs were congestion and oedema on the head. Among others, erythema, apathy, thinness, nasal discharge and crusts, respiratory and locomotion troubles were also occasionally observed.

The frequency and the duration of observation of these signs were markedly higher in controls than in the vaccinated groups.

In the control group (G7), mean daily clinical score peaked on D50 (i.e. 8 days after challenge) at a value of 8.8 and was constantly higher than in any vaccinated groups. The average GCS of G7 was 50. In the vaccinated groups, mean daily clinical score was very low throughout the monitoring period. When compared to the control group (G7), GCS were statistically significantly (p≤0.01) reduced all vaccinated groups except G2. For G2, the difference was close to statistical significance.

Viraemia Results

Figure 13:
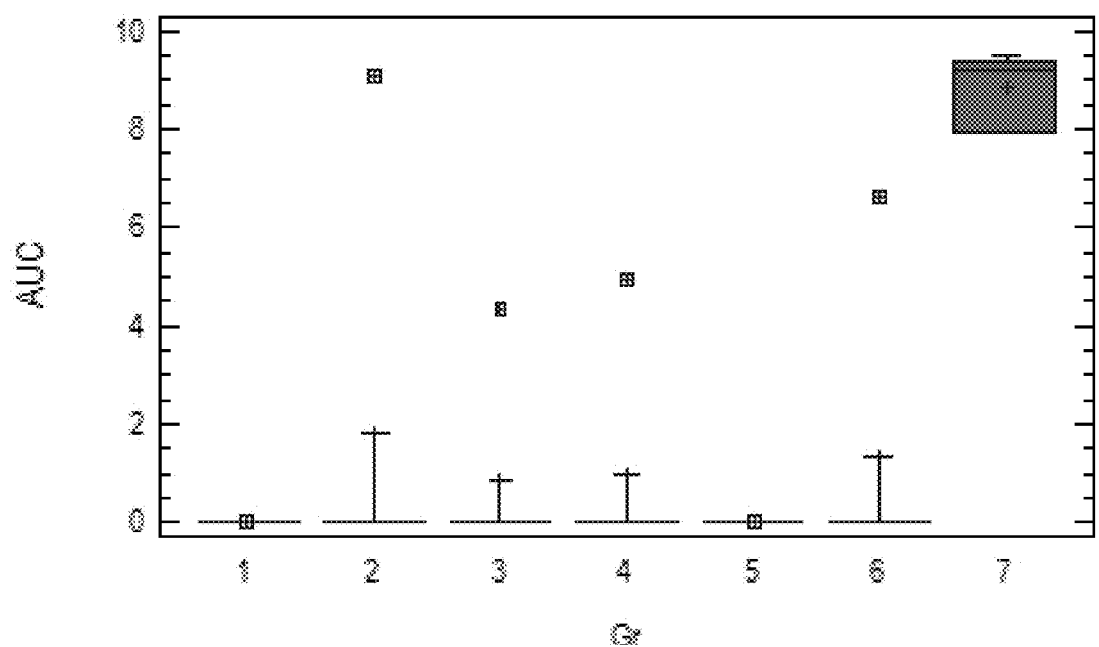
FIG. 13 depicts the dispersions of AUC.

Evolution of mean viraemia titres are summarised in FIG. 12. Frequencies of PCR positive samples and AUCs are shown in Table 5. FIG. 13 shows dispersions of AUCs.

All the sheep were confirmed RT-PCR negative before challenge. In the control group, all sheep were positive on D47 (i.e. 5 days after the challenge) and they all remained positive, at rather high titres, until the end of the monitoring period.

In the vaccinated groups G3 and G4, one sheep was detected lowly positive on the sampling date immediately following inoculation. Both sheep were then always found negative. These transient, lowly positive, results were most likely due to detection of a remainder of the challenge inoculum, and were clearly not attributable to a viral multiplication.

When compared to the control group (G7), Areas Under the Curve were statistically significantly (p≤0.01) reduced in all vaccinated groups except G2. For G2, the difference was close to statistical significance. Complete prevention of viraemia was considered achieved in G1, G3, G4 and G5.

TABLE 5

Frequencies of PCR positive samples and AUC

| Group | Frequency of PCR positive on days | | | | | Total number of PCR positive samples | Area Under the Curve (AUC) | |
|---|---|---|---|---|---|---|---|---|
| | D47 | D49 | D51 | D54 | D56 | | mean | sd |
| G1 (VP2 high dose, D0/D21) | 0/5 | 0/5 | 0/5 | 0/5 | 0/5 | 0/25 | 0.00 | 0.00 |
| G2 (VP2 high dose, D21) | 1/5 | 1/5 | 1/5 | 1/5 | 1/5 | 5/25 | 1.82 | 4.06 |
| G3 (VP2 low dose, D21) | 0/5 | 0/5 | 0/5 | 0/5 | 0/5 | 0/25 | 0.87 | 1.95 |
| G4 (VP2 + VP5, D0/D21) | 0/5 | 0/5 | 0/5 | 0/5 | 0/5 | 0/25 | 0.99 | 2.20 |
| G5 (VP2 + VP5, D21) | 0/5 | 0/5 | 0/5 | 0/5 | 0/5 | 0/25 | 0.00 | 0.00 |
| G6 (commercial vaccine BR8)* | 1/5 | 1/5 | 1/5 | 1/5 | 1/5 | 5/25 | 1.33 | 2.98 |
| G7 (unvaccinated) | 6/6 | 6/6 | 6/6 | 5/5** | 5/5 | 28/28 | 8.85 | 0.73 |

*commercial vaccine BR8: Commercial BTV-8 vaccine (Merial)
**one sheep died on D 53.

Serological Results

Evolution of mean BTV-8 neutralizing antibody titres are summarized in FIG. 14. All sheep were confirmed seronegative before vaccination and the controls remained seronegative until challenge.

In the 2 shots vaccinated groups (G1 and G4), some sero-conversions were observed on D21. On D42, all sheep had sero-converted in both groups and the average titres were almost identical.

In the one shot vaccinated groups (G2, G3, G5 and G6), some sero-conversions were observed 21 days following the vaccination (i.e. D42). While an obvious difference in the serological titres (D42) was observed between the one and two shots vaccinated groups (G1 vs G2 and G4 vs G5), differences in the serological titres according to the antigen payload (G2 vs G3) were less obvious.

All sheep strongly sero-converted after challenge (D56) and there was clear a booster effect in all vaccinated groups.

Conclusion

The results showed that the constructs provided significant reduction of hyperthermia, significant reduction of clinical signs, and complete and significant prevention of viraemia.

Example 3 Production of Synthetic BTV of Multiple Serotypes

Using the reverse-genetic system as described in Example 1, "synthetic" BTV reassortants (sBTV) were generated covering 24 of the 26 different serotypes in which each VP2 was coupled with the homologous VP5 protein in a BTV-1 backbone (VP1, VP3, VP4, NS1, VP7, NS2, VP6 and NS3 proteins) as shown in Table 6 below. The term "synthetic" was used to describe the platform because genome segments can be syntesized in vitro from a known sequence, rather than by amplifying the genome of a virus isolate.

Interestingly and surprisingly, although BTV-25 (Toggenburg Orbivirus) did not grow in cell culture, by introducing the untranslated regions of BTV-1 into the coding sequence of the VP2 and VP5 proteins we were able to rescue an sBTV of the BTV-25 serotype. Thus the vaccine platform can be extremely useful for those virus strains that cannot be isolated easily in tissue culture.

TABLE 6

Available sBTV viruses synthesized by the reverse-genetic system

| Virus Code | Serotype | VP2 Protein | VP5 Protein | Backbone | Alternative name+ |
|---|---|---|---|---|---|
| RAS 8 | BTV-01 | BTV-01 | BTV-01 | BTV-01 | $s_1$BTV-1$_{VP2/VP5}$ |
| RAS 41 | BTV-02 | BTV-02 | BTV-01 | BTV-01 | —/— |
| RFN 51 | BTV-02 | BTV-02 | BTV-02 | BTV-01 | $s_1$BTV-2$_{VP2/VP5}$ |
| RFN 70 | BTV-02 | BTV-02 | BTV-02 | BTV-02 | —/— |
| RFN 30 | BTV-03 | BTV-03 | BTV-06 | BTV-01 | —/— |
| RFN 52 | BTV-03 | BTV-03 | BTV-03 | BTV-01 | $s_1$BTV-3$_{VP2/VP5}$ |
| RAS 40 | BTV-04 | BTV-04 | BTV-01 | BTV-01 | —/— |
| RFN 53 | BTV-04 | BTV-04 | BTV-04 | BTV-01 | $s_1$BTV-4$_{VP2/VP5}$ |
| RFN 71 | BTV-04 | BTV-04 | BTV-04 | BTV-01 | —/— |
| RFN78 | BTV-05 | BTV-05 | BTV-5 | BTV-01 | —/— |
| RFN 32 | BTV-06 | BTV-06 | BTV-06 | BTV-01 | $s_1$BTV-6$_{VP2/VP5}$ |
| RFN 73 | BTV-07 | BTV-07 | BTV-01 | BTV-01 | —/— |
| RAS 32 | BTV-08 | BTV-08 | BTV-08 | BTV-01 | $s_1$BTV-8$_{VP2/VP5}$ |
| RFN 56 | BTV-09 | BTV-09 | BTV-09 | BTV-01 | $s_1$BTV-9$_{VP2/VP5}$ |
| RAS 39 | BTV-09it | BTV-09 | BTV-01 | BTV-01 | —/— |
| RFN 74 | BTV-10 | BTV-10 | BTV-01 | BTV-01 | —/— |
| RFN 35 | BTV-11 | BTV-11 | BTV-01 | BTV-01 | —/— |
| RFN 58 | BTV-11 | BTV-11 | BTV-11 | BTV-01 | $s_1$BTV-11$_{VP2/VP5}$ |
| RFN 75 | BTV-12 | BTV-12 | BTV-01 | BTV-01 | —/— |
| RFN 37 | BTV-13 | BTV-13 | BTV-13 | BTV-01 | $s_1$BTV-13$_{VP2/VP5}$ |
| RFN 38 | BTV-14 | BTV-14 | BTV-06 | BTV-01 | $s_1$BTV-14$_{VP2}$ |
| RFN76 | BTV-16 | BTV-16 | BTV-01 | BTV-01 | —/— |
| RFN 79 | BTV-16 | BTV-16 | BTV-10 | BTV-01 | —/— |
| RFN 80 | BTV-16 | BTV-16 | BTV-11 | BTV-01 | —/— |
| RFN 81 | BTV-16 | BTV-16 | BTV-16 | BTV-01 | —/— |
| RFN 82 | BTV-16 | BTV-16 | BTV-21 | BTV-01 | —/— |
| RFN 83 | BTV-16 | BTV-16 | BTV-22 | BTV-01 | —/— |
| RFN 84 | BTV-16 | BTV-16 | BTV-23 | BTV-01 | —/— |
| RFN 85 | BTV-16 | BTV-16 | BTV-26 | BTV-01 | —/— |
| RFN 41 | BTV-17 | BTV-17 | BTV-01 | BTV-01 | —/— |
| RFN 63 | BTV-17 | BTV-17 | BTV-17 | BTV-01 | $s_1$BTV-17$_{VP2/VP5}$ |
| RFN 77 | BTV-18 | BTV-18 | BTV-01 | BTV-01 | —/— |
| RFN 44 | BTV-20 | BTV-20 | BTV-10 | BTV-01 | —/— |
| RFN 66 | BTV-20 | BTV-20 | BTV-20 | BTV-01 | $s_1$BTV-20$_{VP2/VP5}$ |
| RFN 45 | BTV-21 | BTV-21 | BTV-16 | BTV-01 | —/— |
| RFN 67 | BTV-21 | BTV-21 | BTV-21 | BTV-01 | $s_1$BTV-21$_{VP2/VP5}$ |
| RFN 46 | BTV-22 | BTV-22 | BTV-22 | BTV-01 | $s_1$BTV-22$_{VP2/VP5}$ |
| RFN 47 | BTV-23 | BTV-23 | BTV-01 | BTV-01 | —/— |
| RFN 68 | BTV-23 | BTV-23 | BTV-23 | BTV-01 | $s_1$BTV-23$_{VP2/VP5}$ |
| RFN 48 | BTV-24 | BTV-24 | BTV-04 | BTV-01 | $s_1$BTV-24$_{VP2}$ |
| RFN 49 | BTV-25 | BTV-25 (1UTRs)# | BTV-25 (1UTRs)# | BTV-01 | $s_1$BTV-25$_{VP2/VP5}$ |
| RFN 50 | BTV-26 | BTV-26 | BTV-26 | BTV-01 | $s_1$BTV-26$_{VP2/VP5}$ |

Protein coding region flanked by the untranslated regions of BTV-1

Characterization and Replication In Vitro of sBTV

Viral stocks of each sBTV viruses were grown and titrated in BSR cells. Plaque phenotype was evaluated by plaque assay in sheep cells at 72 hours post-infection (FIG. 15). As mentioned before, all serotypes rescued have the homologous VP2/VP5 combination.

The sBTV replication was determined in BHK-21 cells (infected with an MOI of 0.001). Cell supernatants were collected at 72 h post-infection (FIG. 16). Triplicate samples were subsequently titrated by TCID$_{50}$ in BHK-21 cells (using Reed-Muench method) and plotted as Log$_{10}$TCID$_{50}$/ml.

Example 4 Production of Inactivated Reasortant Virus

Two construct strains as reassortant BTV, one corresponding to VP2 from BTV8 in BTV-1 backbone and the second one with VP2NP5 from BTV8 in BTV-1 backbone were amplified in BHK21 cells.

Production of Cells

A 7 L bioreactor was inoculated (passage 48) with 5 litres of GMEM medium with 7% of calf serum and 2×10$^9$ cells (6BHK2M12-passage 47). The culture was regulated using as parameters: pH: 7.1±0.1, temperature: 37.0±1.5° C., DO2: 40±10% and agitation: 300 rpm±10%. After 2 days of culture, a numeration was performed. The total volume of the suspension was transferred in B4 bioreactor previously sterilized and containing 35 litres of GMEM medium+7% CS. The culture was regulated using as parameters: pH: 7.1±0.1, temperature: 37.0±1.5° C., DO2: 40±10% and agitation: 150 rpm±10%. After 3 days of culture, the stirring of the bioreactor was stopped for decantation of cells during about 24 hours at +5° C. After decantation, the medium was eliminated, (remaining volume=5 litres). VMM medium was added (30 litres). After mixing, a cell counting was carried out and the inoculum was added: inoculum BTV1+BTV8 VP2 (RAS10) for the first active ingredient and inoculum BTV1+BTV8 VP2NP5 (RAS32) for the second one. The final volume in the bioreactor was 35 litres, the volumes of inoculum were calculated to obtain a MOI equal to 5 10$^{-4}$ CCID$_{50}$/cell. The parameters of the culture were: pH: 7.4±0.1, temperature: 37.0±1.5° C., DO2: 40±10%, agitation: 100 rpm±10% and pressure: 0.1 bars±10%. The culture was stopped after about 46 hours by cooling under stirring.

Treatment Before Inactivation

The regulation of oxygen was stopped and chloroform was added to obtain a final concentration of 0.05%. The mixture was left under stirring at about 8° C. during one hour with a regulation of the pH at 7.4±0.1. The pH regulation was stopped and the product stored at about +8° C. without stirring until treatment. About 24 litres of the culture were treated with ultra-turrax T50: 8 samples of 3000 ml at 1000 watts for 3 minutes at laboratory temperature. The samples were pooled after treatment.

The product was then clarified by centrifugation (20 minutes at 3500 rpm, 20° C.). The supernatant was filtrated and stored at +5° C. before inactivation.

Inactivation

The supernatant filtrate was heated at 37° C. and the pH was adjusted to 7.4±0.1. Formaldehyde solution was added to obtain a final concentration of 0.5 mg/ml. Twenty minutes after, one dose of EI was added to obtain a final concentration of 1.5 mM. 18 hours after, a second dose of EI was added (same concentration). The inactivation step was carried out at 37° C. for 24 hours (T0=time of the first addition of EI). During this inactivation step, samples were carried out and treated by a solution of L-Cystein.

Filtration and Concentration

The inactivated product was filtrated (CUNO 30S). The new volume was measured. The filtrate was concentrated at laboratory temperature, the factor of concentration was calculated.

Purification and formaldehyde treatment

The concentrate was purified using column XK 25/100 with S6FF. Two runs were performed. Conditions of purification were: volume of sample: 15% of the column (about 60 ml); buffer for elution: phosphate buffer pH 7.4; speed of elution: 2.5 ml/min. Exclusion peak (Active Ingredient), Safety fraction, and Protein peak were collected separately. Formaldehyde solution was added to the Active Ingredient to obtain a final concentration of 1 mg/ml stored at +5° C.

The results for infectious titre, ELISA, Dot Blot Vp2 for BTV1+BTV8 VP2 (RAS10) and BTV1+BTV8 VP2NP5 (RAS32) are shown in FIGS. 17 and 18. The production of the two purified inactivated BTV reassortants was successfully performed. These two reassortants were used to formulate vaccines.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

All documents cited or referenced in the application cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention.

REFERENCES

Anderson, G. A., J. L. Stott, et al. (1985). "Subclinical and clinical bluetongue disease in cattle: clinical, pathological and pathogenic considerations." *Prog Clin Biol Res* 178: 103-7.

Andreansky, S. S., B. He, et al. (1996). "The application of genetically engineered herpes simplex viruses to the treatment of experimental brain tumors." *Proc Natl Acad Sci USA* 93(21): 11313-8.

Andrew, M., P. Whiteley, et al. (1995). "Antigen specificity of the ovine cytotoxic T lymphocyte response to bluetongue virus." *Vet Immunol Immunopathol* 47(3-4): 311-22.

Antoine, G., F. Scheiflinger, et al. (1998). "The complete genomic sequence of the modified vaccinia Ankara strain: comparison with other orthopoxviruses." *Virology* 244(2): 365-96.

Ballay, A., M. Levrero, et al. (1985). "In vitro and in vivo synthesis of the hepatitis B virus surface antigen and of the receptor for polymerized human serum albumin from recombinant human adenoviruses." *Embo J* 4(13B): 3861-5.

Barcena, J., M. M. Lorenzo, et al. (2000). "Sequence and analysis of a swinepox virus homologue of the vaccinia virus major envelope protein P37 (F13L)." *J Gen Virol* 81(Pt 4): 1073-85.

Bernard, K. A., B. A. Israel, et al. (1997). "Sequence and cognitive analyses of two virulence-associated markers of bluetongue virus serotype 17." *Intervirology* 40(4): 226-31.

Bonneau, K. R., C. D. DeMaula, et al. (2002). "Duration of viremia infectious to *Culicoides sonorensis* in bluetongue virus-infected cattle and sheep." *Vet Microbiol* 88(2): 115-25.

Bonneau, K. R., B. A. Mullens, et al. (2001). "Occurrence of genetic drift and founder effect during quasispecies evolution of the VP2 and NS3/NS3A genes of bluetongue virus upon passage between sheep, cattle, and *Culicoides sonorensis*." *J Virol* 75(17): 8298-305.

Bonneau, K. R., N. Zhang, et al. (1999). "Sequence comparison of the L2 and S10 genes of bluetongue viruses from the United States and the People's Republic of China." *Virus Res* 61(2): 153-60.

Boshart, M., F. Weber, et al. (1985). "A very strong enhancer is located upstream of an immediate early gene of human cytomegalovirus." *Cell* 41(2): 521-30.

Bradel-Tretheway, B. G., Z. Zhen, et al. (2003). "Effects of codon-optimization on protein expression by the human herpesvirus 6 and 7 U51 open reading frame." *J Virol Methods* 111(2): 145-56.

Carroll, M. W., W. W. Overwijk, et al. (1997). "Highly attenuated modified vaccinia virus Ankara (MVA) as an effective recombinant vector: a murine tumor model." *Vaccine* 15(4): 387-94.

Cochran, M. A., C. Puckett, et al. (1985). "In vitro mutagenesis of the promoter region for a vaccinia virus gene: evidence for tandem early and late regulatory signals." *J Virol* 54(1): 30-7.

Cowley, J. A. and B. M. Gorman (1989). "Cross-neutralization of genetic reassortants of bluetongue virus serotypes 20 and 21." *Vet Microbiol* 19(1): 37-51.

De Groot, A. S, and F. G. Rothman (1999). "In silico predictions; in vivo veritas." *Nat Biotechnol* 17(6): 533-4.

de Mattos, C. A., C. C. de Mattos, et al. (1994). "Heterogeneity of the L2 gene of field isolates of bluetongue virus serotype 17 from the San Joaquin Valley of California." *Virus Res* 31(1): 67-87.

DeMaula, C. D., K. R. Bonneau, et al. (2000). "Changes in the outer capsid proteins of bluetongue virus serotype ten that abrogate neutralization by monoclonal antibodies." *Virus Res* 67(1): 59-66.

DeMaula, C. D., H. W. Heidner, et al. (1993). "Neutralization determinants of United States bluetongue virus serotype ten." *Virology* 195(1): 292-6.

DeMaula, C. D., C. M. Leutenegger, et al. (2002). "The role of endothelial cell-derived inflammatory and vasoactive mediators in the pathogenesis of bluetongue." *Virology* 296(2): 330-7.

Disbrow, G. L., I. Sunitha, et al. (2003). "Codon optimization of the HPV-16 E5 gene enhances protein expression." *Virology* 311(1): 105-14.

Felgner, J. H., R. Kumar, et al. (1994). "Enhanced gene delivery and mechanism studies with a novel series of cationic lipid formulations." *J Biol Chem* 269(4): 2550-61.

Frolov, I., T. A. Hoffman, et al. (1996). "Alphavirus-based expression vectors: strategies and applications." *Proc Natl Acad Sci USA* 93(21): 11371-7.

Funahashi, S., T. Sato, et al. (1988). "Cloning and characterization of the gene encoding the major protein of the A-type inclusion body of cowpox virus." *J Gen Virol* 69 (Pt 1): 35-47.

Geysen, H. M. (1990). "Molecular technology: peptide epitope mapping and the pin technology." *Southeast Asian J Trop Med Public Health* 21(4): 523-33.

Geysen, H. M., S. J. Barteling, et al. (1985). "Small peptides induce antibodies with a sequence and structural requirement for binding antigen comparable to antibodies raised against the native protein." *Proc Natl Acad Sci USA* 82(1): 178-82.

Geysen, H. M., R. H. Meloen, et al. (1984). "Use of peptide synthesis to probe viral antigens for epitopes to a resolution of a single amino acid." *Proc Natl Acad Sci USA* 81(13): 3998-4002.

Ghiasi, H., A. Fukusho, et al. (1987). "Identification and characterization of conserved and variable regions in the neutralization VP2 gene of bluetongue virus." *Virology* 160(1): 100-9.

Graham, F. L. (1990). "Adenoviruses as expression vectors and recombinant vaccines." *Trends Biotechnol* 8(4): 85-7.

Guo, P. X., S. Goebel, et al. (1989). "Expression in recombinant vaccinia virus of the equine herpesvirus 1 gene encoding glycoprotein gp13 and protection of immunized animals." *J Virol* 63(10): 4189-98.

Hartikka, J., M. Sawdey, et al. (1996). "An improved plasmid DNA expression vector for direct injection into skeletal muscle." *Hum Gene Ther* 7(10): 1205-17.

Hassan, S. S. and P. Roy (1999). "Expression and functional characterization of bluetongue virus VP2 protein: role in cell entry." *J Virol* 73(12): 9832-42.

Heidner, H. W., P. V. Rossitto, et al. (1990). "Identification of four distinct neutralizing epitopes on bluetongue virus serotype 10 using neutralizing monoclonal antibodies and neutralization-escape variants." *Virology* 176(2): 658-61.

Hemmer, B., C. Pinilla, et al. (1998). "The use of soluble synthetic peptide combinatorial libraries to determine antigen recognition of T cells." *J Pept Res* 52(5): 338-45.

Huang, I. J., G. Y. Hwang, et al. (1995). "Sequence analyses and antigenic epitope mapping of the putative RNA-directed RNA polymerase of five U.S. bluetongue viruses." *Virology* 214(1): 280-8.

Huismans, H. and B. J. Erasmus (1981). "Identification of the serotype-specific and group-specific antigens of bluetongue virus." *Onderstepoort J Vet Res* 48(2): 51-8.

Huismans, H., N. T. van der Walt, et al. (1987). "Isolation of a capsid protein of bluetongue virus that induces a protective immune response in sheep." *Virology* 157(1): 172-9.

Jewell, J. E. and J. O. Mecham (1994). "Identification of an amino acid on VP2 that affects neutralization of bluetongue virus serotype 10." *Virus Res* 33(2): 139-44.

Ju, Q., D. Edelstein, et al. (1998). "Transduction of non-dividing adult human pancreatic beta cells by an integrating lentiviral vector." *Diabetologia* 41(6): 736-9.

Kim, C. H., Y. Oh, et al. (1997). "Codon optimization for high-level expression of human erythropoietin (EPO) in mammalian cells." *Gene* 199(1-2): 293-301.

Kitson, J. D., K. L. Burke, et al. (1991). "Chimeric polioviruses that include sequences derived from two independent antigenic sites of foot-and-mouth disease virus (FMDV) induce neutralizing antibodies against FMDV in guinea pigs." *J Virol* 65(6): 3068-75.

Klinman, D. M., A. K. Yi, et al. (1996). "CpG motifs present in bacteria DNA rapidly induce lymphocytes to secrete interleukin 6, interleukin 12, and interferon gamma" *Proc Natl Acad Sci USA* 93(7): 2879-83.

Kwissa, M., K. van Kampen, et al. (2000). "Efficient vaccination by intradermal or intramuscular inoculation of plasmid DNA expressing hepatitis B surface antigen under desmin promoter/enhancer control." *Vaccine* 18(22): 2337-44.

Laval, F., R. Paillot, et al. (2002). "Quantitative analysis of the antigen-specific IFNgamma+T cell-mediated immune response in conventional outbred pigs: kinetics and duration of the DNA-induced IFNgamma+CD8+T cell response." *Vet Immunol Immunopathol* 90(3-4): 191-201.

Lobato, Z. I., B. E. Coupar, et al. (1997). "Antibody responses and protective immunity to recombinant vaccinia virus-expressed bluetongue virus antigens." *Vet Immunol Immunopathol* 59(3-4): 293-309.

Luckow, V. A. and M. D. Summers (1988). "Signals important for high-level expression of foreign genes in *Autographa californica* nuclear polyhedrosis virus expression vectors." *Virology* 167(1): 56-71.

MacLachlan, N.J. (1994). "The pathogenesis and immunology of bluetongue virus infection of ruminants." *Comp Immunol Microbiol Infect Dis* 17(3-4): 197-206.

MacLachlan, N. J. and J. E. Pearson (2004). Bluetongue: Prodeedings of the Third International Symposium. *Bluetongue: Prodeedings of the Third International Symposium*. N. J. MacLachlan and J. E. Pearson, Vet Italiana. 40:1-730.

Marshall, E., L. B. Woolford, et al. (1997). "Continuous infusion of macrophage inflammatory protein MIP-1alpha enhances leucocyte recovery and haemopoietic progenitor cell mobilization after cyclophosphamide." *Br J Cancer* 75(12): 1715-20.

Martinez-Torrecuadrada, J. L., J. P. Langeveld, et al. (1999). "Antigenic profile of African horse sickness virus serotype 4 VP5 and identification of a neutralizing epitope shared with bluetongue virus and epizootic hemorrhagic disease virus." *Virology* 257(2): 449-59.

McClements, W. L., M. E. Armstrong, et al. (1996) "Immunization with DNA vaccines encoding glycoprotein D or glycoprotein B, alone or in combination, induces protective immunity in animal models of herpes simplex virus-2 disease." *Proc Natl Acad Sci USA* 93(21): 11414-20.

Mecham, J. O., V. C. Dean, et al. (1986). "Correlation of serotype specificity and protein structure of the five U.S. serotypes of bluetongue virus." *J Gen Virol* 67 (Pt 12): 2617-24. Mecham, J. O. and D. J. Johnson (2005). "Persistence of bluetongue virus serotype 2 (BTV-2) in the southeast United States." *Virus Res* 113(2): 116-22.

Miyazaki, J., S. Takaki, et al. (1989). "Expression vector system based on the chicken beta-actin promoter directs efficient production of interleukin-5." *Gene* 79(2): 269-77.

Moss, B. (1996). "Genetically engineered poxviruses for recombinant gene expression, vaccination, and safety." *Proc Natl Acad Sci USA* 93(21): 11341-8.

Mullens, B. A., W. J. Tabachnick, et al. (1995). "Effects of temperature on virogenesis of bluetongue virus serotype 11 in *Culicoides variipennis sonorensis*." *Med Vet Entomol* 9(1): 71-6.

Paoletti, E. (1996). "Applications of pox virus vectors to vaccination: an update." *Proc Natl Acad Sci USA* 93(21): 11349-53.

Pearson, W. R. and D. J. Lipman (1988). "Improved tools for biological sequence comparison." *Proc Natl Acad Sci USA* 85(8): 2444-8.

Pennock, G. D., C. Shoemaker, et al. (1984). "Strong and regulated expression of *Escherichia coli* beta-galactosidase in insect cells with a baculovirus vector." *Mol Cell Biol* 4(3): 399-406.

Perkus, M. E., K. Limbach, et al. (1989). "Cloning and expression of foreign genes in vaccinia virus, using a host range selection system." *J Virol* 63(9): 3829-36.

Powell, M. F. and M. J. Newman (1995). Vaccine Design, The Subunit and Adjuvant Approach. *A Compendium of Vaccine Adjuvants and Excipients*. F. Vogel and M. Powell. New York, Plenum Press. 6: 147, 183.

Prevec, L., M. Schneider, et al. (1989). "Use of human adenovirus-based vectors for antigen expression in animals." *J Gen Virol* 70 (Pt 2): 429-34.

Pritchard, L. I. and A. R. Gould (1995). "Phylogenetic comparison of the serotype-specific VP2 protein of bluetongue and related orbiviruses." *Virus Res* 39(2-3): 207-20.

Regelson, W., S. Kuhar, et al. (1960). "Synthetic polyelectrolytes as tumour inhibitors." *Nature* 186: 778-80.

Riviere, M., J. Tartaglia, et al. (1992). "Protection of mice and swine from pseudorabies virus conferred by vaccinia virus-based recombinants." *J Virol* 66(6): 3424-34.

Robertson, E. S., T. Ooka, et al. (1996). "Epstein-Barr virus vectors for gene delivery to B lymphocytes." *Proc Natl Acad Sci USA* 93(21): 11334-40.

Robinson, H. L. and C. A. Torres (1997). "DNA vaccines." *Semin Immunol* 9(5): 271-83.

Roizman, B. (1996). "The function of herpes simplex virus genes: a primer for genetic engineering of novel vectors." *Proc Natl Acad Sci USA* 93(21): 11307-12.

Rossitto, P. V. and N.J. MacLachlan (1992). "Neutralizing epitopes of the serotypes of bluetongue virus present in the United States." *J Gen Virol* 73 (Pt 8): 1947-52.

Roy, P. (1992). "Bluetongue virus proteins." *J Gen Virol* 73 (Pt 12): 3051-64.

Roy, P. (1996). "Orbivirus structure and assembly." *Virology* 216(1): 1-11.

Roy, P. (1996). Orbiviruses and their replication. *Fields Virology*. B. N. Fields, D. M. Knipe, P. M. Howley. Philadelphia, Pa., Lippincott-Raven: 1709-1734.

Roy, P., T. Urakawa, et al. (1990). "Recombinant virus vaccine for bluetongue disease in sheep." *J Virol* 64(5): 1998-2003.

Sambrook, J. and D. W. Russell (2001). *Molecular Cloning: a laboratory manual/Joseph Sambrook*, David W. Russell. Cold Spring Harbor, N.Y., Cold Spring Harbor Laboratory Press.

Schneider, K., F. Puehler, et al. (2000). "cDNA cloning of biologically active chicken interleukin-18." *J Interferon Cytokine Res* 20(10): 879-83.

Shida, H. (1986). "Nucleotide sequence of the vaccinia virus hemagglutinin gene." *Virology* 150(2): 451-62.

Smith, G. E., M. D. Summers, et al. (1983). "Production of human beta interferon in insect cells infected with a baculovirus expression vector." *Mol Cell Biol* 3(12): 2156-65.

Snedecor, G. W. & COCHRAN, W. G. (1971) Transformation de proportions en Arcsinus. In Méthodes Statistiques. 6th edn. Eds H. Boelle, E. Camhaji. Association de Coordination Technique Agricole. pp 366-367

Spreull, J. (1905). "Malarial catarrhal fever (bluetongue) of sheep in South Africa." *J. Comp. Path. Ther.* 18: 321-337.

Stickl, H. and V. Hochstein-Mintzel (1971). "[Intracutaneous smallpox vaccination with a weak pathogenic vaccinia virus ("MVA virus")]." *Munch Med Wochenschr* 113(35): 1149-53.

Stittelaar, K. J., L. S. Wyatt, et al. (2000). "Protective immunity in macaques vaccinated with a modified vaccinia virus Ankara-based measles virus vaccine in the presence of passively acquired antibodies." *J Virol* 74(9): 4236-43.

Sutter, G. and B. Moss (1992). "Nonreplicating vaccinia vector efficiently expresses recombinant genes." *Proc Natl Acad Sci USA* 89(22): 10847-51.

Sutter, G., L. S. Wyatt, et al. (1994). "A recombinant vector derived from the host range-restricted and highly attenuated MVA strain of vaccinia virus stimulates protective immunity in mice to BTV or FMDV virus." *Vaccine* 12(11): 1032-40.

Tang, D.C., M. DeVit, et al. (1992). "Genetic immunization is a simple method for eliciting an immune response." *Nature* 356(6365): 152-4.

Taylor, J., R. Weinberg, et al. (1988). "Protective immunity against avia BTV or FMDV induced by a fowlpox virus recombinant." *Vaccine* 6(6): 504-8.

Thompson, J. D., D. G. Higgins, et al. (1994). "CLUSTAL W: improving the sensitivity of progressive multiple sequence alignment through sequence weighting, position-specific gap penalties and weight matrix choice." *Nucleic Acids Res* 22(22): 4673-80.

Ulmer, J. B., J. J. Donnelly, et al. (1993). "Heterologous protection against BTV or FMDV by injection of DNA encoding a viral protein." *Science* 259(5102): 1745-9.

Van der Zee, R., W. Van Eden, et al. (1989). "Efficient mapping and characterization of a T cell epitope by the simultaneous synthesis of multiple peptides." *Eur J Immunol* 19(1): 43-7.

van Ooyen, A., J. van den Berg, et al. (1979). "Comparison of total sequence of a cloned rabbit beta-globin gene and its flanking regions with a homologous mouse sequence." *Science* 206(4416): 337-44.

Verwoerd, D. W., H. J. Els, et al. (1972). "Structure of the bluetongue virus capsid." *J Virol* 10(4): 783-94.

Vialard, J., M. Lalumiere, et al. (1990). "Synthesis of the membrane fusion and hemagglutinin proteins of measles virus, using a novel baculovirus vector containing the beta-galactosidase gene." *J Virol* 64(1): 37-50.

Wang, L. F., D. H. Du Plessis, et al. (1995). "Use of a gene-targeted phage display random epitope library to map an antigenic determinant on the bluetongue virus outer capsid protein VP5." *J Immunol Methods* 178(1): 1-12.

White, D. M., W. C. Wilson, et al. (2005). "Studies on overwintering of bluetongue viruses in insects." *J Gen Virol* 86(Pt 2): 453-62.

Wilson, W. C. and J. O. Mecham (2000). "Molecular Evolution of Orbiviruses." *Proc USAHA* 104: 169-180.

Xin, K. Q., K. Hamajima, et al. (1999). "IL-15 expression plasmid enhances cell-mediated immunity induced by an HIV-1 DNA vaccine." *Vaccine* 17(7-8): 858-66.

SEQUENCE LISTING (194 sequences)

SEQ ID NO: 1 - protein, 1302 aa, artificial sequence
  VP1 of BTV-1 ACR58458
MVAITVQGAQLIKRVVERFYPGIAFNIDEGACYIYKFSDHIRRIRMKHGTKYRRQAEEIMRNISLRKERLYGIPVLDEVEWKYVFDGQTFQSYAFEVYVNSILPWSELDPEEEFLRNYRVSREMTEVEKFIEFRAKNEMQIYGDIPIKVWCCFINELSAELKHIPLGMQVMADFVNRFDSPFHQGNRDLSNLEDFQVAYTTPLLFEMCCMESILEFNIKMRMREEDISALEFGDMKVDPVGLLREFFILCLPHPKKINNVLRAPYSWFVKMWGVGADPIVVLQSTAGDDRNSKDVFYDKFRTEPNRYKALFRSSFYNESRRMNEEKILEAVKYSQKLGSHERRLPLFEKMLKTVYTTPFYPHKSSNMILASFLLSIQTITGYGRAWVKNVSTEFDKQLKPNPSNLVQDVSDLTREFFKQAYVEAKERREEIVKPEDLYTSMLRLARNTSSGFSTEIYVKKRFGPRLRDKDLIKINSRIKALVIFTKGHTVFTDEELHKKYNSVELYQTKGSRDVPIKATRTIYSINLSVLVPQLIVTLPLNEYFSRVGGITSPDYKKIGGKVIVGDLEATGSRVMDAADCFRNSADRDIFTIAIDYSEYDTHLTRHNFRTGMLQGIREAMAPYRDLRYEGYTLEQIIDFGYGEGRVANTLWNGKRRLFKTTFDAYIRLDESERDKGSFKVPKGVLPVSSIDVANRIAVDKGFDTLIAATDGSDLALIDTHLSGENSTLIANSMHNMAIGTLIQREVGKEQPGILTFLSEQYVGDDTLFYTKLHTTDTKVFDKVAASIFNTVAKCGHEASPSKTMMTPYSVEKTQTHAKQGCYVPQDRMMIISSERRKDIEDVQGYVRSQVQTMITKVSRGFCHDLAQLILMLKTTFIGAWKMKRTIKEDAMYRDRKFDSNDEDGFTLIQIRNPLALYVPIGWNGYGAHPAALNIVMTEEMYVDSIMISKLDEIMAPIRRIVHDIPPCWNETQGDKRGLISATKMSFFSKMARPAVQAALSDPQIMNLVEELPLGEFSPGRISRTMMHSALLKESSARTLLSSGYELEYQKALNSWIAQVSMRLGEESGVISTSYAKLFDVYFEGELDGAPYMFPDQNLSPQFYIQKMMIGPRVSSRVRNSYVDRIDVILRKDVVMRGFITANTILNVIEKLGTNHSVGDLVTVFTLMNIETRVAEELAEYMTSEKIRFDALKLLKKGIAGDEFTMSLNVATQDFIDTYLAYPYQLTKTEVDAISLYCTQMVMLRAALGLPKKKMKIVVTDDAKKRYKIRLQRFRTHVPKIKVLKKLIDPNRMTVRNLENQFV

SEQ ID NO: 2 - protein, 961 aa, artificial sequence
  VP2 of BTV1 ACR58459
MDELGIPVYKRGFPEHLLRGYEFIIDVGTKIESVGGRHDVTKIPEMNAYDIKQESIRTALWYNPIRNDGFVLPRVLDITLRGYDERRAVVESTRHKSFHTNDQWVQWMMKDSMDAQPLKVGLDDQSRNVAHSLHNCVVKIDSKKADTMSYHVEPIEDASKGCLHTRTMMWNHLVRIETFHAAQEVAYTLKPTYDIVVHAERRDRSQPFRPGDQTLINFGRGQKVAMNHNSYDKMVEGLTHLVIRGKTPEVIRDDIASLDEICNRWIQSRHDPGEIKAYELCKILSTIGRKVLDREKEPEDEANLSIRFQEAIDNKFRQHDPERLKIFEHRNQRRDEDRFYILLMIAASDTFNTRVWWSNPYPCLRGTLIASETKLGDVYSMMRSWYDWSVRPTYTPYEKTREQEKYIYGRVNLFDFVAEPGIKIVHWEYRLNHSTREITYAQGNPCDLYPEDDDVIVTKFDDVAYGQMINEMINGGWNQEQFKMHKILKSEGNVLTIDFEKDAKLTTNEGVTMPEYFNKWIIAPMFNAKLRIKHEEIAQRQSDDPMVKRTLSPITADPIELQRLTLARFYDIRPALRGQALSRQQAQSTYDEEISKQRDYAEILKRRGIVQIPKKPCPTVTAQYTLERYALFIINILQQHVARDCDEEAIYEHPKADYELEIFGESIVDISQVIVLVFDLIFERRRRVRDVYESRYIIARIRRMRGKERLNVIAEFFPTYGSLLNGLNSATVVQDIMYLNFLPLYFLAGDNMIYSHRQWSIPLLLYTHEVMVVPLEVGSYNDRCGLIAYLEYMVFFPSKAIRLSKLNEAQPKIAREMLKYYANTAVYDGGVNYNVVTTKQLLYETYLASLCGGISDGIVWYLPITHPNKCIVAIEVSDERVPASIRAGRIRLRFPLSARHLKGVVIIQIDEEGEFTVYSEGIVSHRVCKKNLLKYMCDIILLKFSGHVFGNDEMLTKLLNV

SEQ ID NO: 3 - protein, 901 aa, artificial sequence
  VP3 of BTV1 ACR58460
MAAQNEQRPERIKTTPYLEGDVLSSDSGPLLSVFALQEIMQKVRQVQADYMTATREVDFTVPDVQKILDDIKALAAEQVYKIVKVPSISFRHIVMQSRDRVLRVDTYYEEMSQVGDVITEDEPEKFYSTIIKKVRFIRGKGSFILHDIPTRDHRGMEVAEPEVLGVEFKNVLPVLTAEHRAMIQNALDGSIIENGNVATRDVDVFIGACSEPIYRIYNRLQGYIEAVQLQELRNSIGWLERLGQRKRITYSQEVLTDFRRQDTIWVLALQLPVNPQVVWDVPRSSIANLIMNIATCLPTGEYIAPNPRISSITLTQRITTTGPFAILTGSTPTAQQLNDVRKIYLALMFPGQIILDLKIDPGERMDPAVRMVAGVVGHLLFTAGGRFTNLTQNMARQLDIALNDYLLYMYNTRVQVNYGPTGEPLDFQIGRNQYDCNVFRADFATGTGYNGWATIDVEYRDPAPYVHAQRYIRYCGIDSRELINPTTYGIGMTYHCYNEMLRMLVAAGKDSEAAYFRSMLPFHMVRFARINQIINEDLHSVFSLPDDMFNALLPDLIAGAHQNADPVVLDVSWISLWFAFNRSFEPTHRNEMLEIAPLIESVYASELSVMKVDMRHLSLMQRRFPDVLIQARPSHFWKAVLNDSPEAVKAVMNLSHSHNFINIRDMMRWVLLPSLQPSLKLVLEEEAWAAANDFEDLMLTDQVYMHRDMLPEPRLDDIERFRQEGFYYTNMLEAPPEIDRVVQYTYEIARLQANMGQFRAALRRIMDDDDWVRFGGVLRTVRVKFFDARPPDDILQGLPFSYDTNEKGGLSYATIKYATETTIFYLIYNVEFSNTPDSLVLINPTYTMTKVFINKRIVERVRVGQILAVLNRRFVAYKGKMRIMDITQSLKMGTKLAAPTV

SEQ ID NO: 4 - protein, 644 aa, artificial sequence
  Vp4 of BTV1 ACR58461
MPEPHAVLYVTNELSHIVKSGFLPIWRLTGDESLNDLWLENGKYATDVYAYGDVSKWTIRQLRGHGFIFVSTHKNIQLADIIKTVDVRIPREVAKSQDMKAFENEIGRRRIRMRKGFGDALRNYAFKMAIEFHGSEAETLNDANPRLHKVYGMPEIPPLYMEYAEIGTRFDDEPTDEKLVSMLDYIVYSAEEVHYVGCGDLRTLMQFKKRSPGRFRRVLWHVYDPIAPESSDPNVIVHNVMVDSKKDILKHMNFLKRVERLFIWDVSSDRSQMDDDEWESTRFAEDRLGEEIAYEMGGAFSSALIKHRIPNSRDEYHCISTYLLPQPGADADMYELRNFMRLKGYSHVDRHMHPDASVMKVVSRDVRKMVELYHGRDRGRFLKKRLFEHLHIVRKNGLLHESDEPRADLFYLTNRCNMGLEPSIYEVMKKSVIATAWVGRAPLYDYDDYALPRSTVMLNGSYRDIRVLDGNGAILFLMWKYPDIVKKDLTYDPAWAMNFAVSLKEPIPDPPVPDISLCRFIGLRVESSVLRVRNPTLHETADELKRMGLDLSGHLYVTLMSGAYVTDLFWWFKMILDWSAQSKEQKLRDLKRSAAEVIEWKEQMAERPWHVRNDLIAALREYKRKMGMREGASIDSWLELLRHL

SEQ ID NO: 5 - protein, 526 aa, artificial sequence
  BP5 of BTV1 ACR58462
MGKVIRSLNRFGKKVGNALTSNTAKKIYSTIGKAAERFAESEIGSAAIDGLVQGSVHSIITGESYGESVKQAVLLNVLGSGEEIPDPLSPGERGIQAKLKELEDEQRNELVRLKYNDKIKEKFGKELEEVYNFMNGEANAEIEDEKQFDILNKAVTSYNKILTEEDLQMRRLATALQKEIGERTHAETVMVKEYRDKIDALKNAIEVERDGMQEEAIQEIAGMTADVLEAASEEVPLIGAGMATAVATGRAIEGAYKLKKVINALSGIDLTHLRTPKIEPSVVSTILEYRAKEIPDNALAVSVLSKNRAIQENHKELMHIKNEILPRFKKAMDEEKEICGIEDKVIHPKVMMKFKIPRAQQPQIHVYSAPWDSDDVFFFHCISHHHANESFFLGFDLSIDLVHYEDLTAHWHALGAAQTAAGRTLTEAYREFLNLAISNAFGTQMHTRRLVRSKTVHPIYLGSLHYDISFSDLRGNAQRIVYDDELQMHILRGPIHFQRRAILGALKFGCKVLGDRLDVPLFLRNA

SEQ ID NO: 6 - protein, 552 aa, artificial sequence
  NS1 of BTV1 ACR58463
MERFLRKYNISGDYANATRTFLAISPQWTCSHLKRNCLFNGMCVKQNFERAMIAATDVEEPAKAYKLVELAKEAMYDRETVWLQCFKSFSQPYEEDVEGKMKRCGVQLLEDYRKSGMMDEAVKQSALVNSERVRLDDSLSAMPYIYVPIKEGQIVNPTFISRYRQIAYYFYNPDAADDWIDPNLFGIRGQHNQIKREVERQINTCPYTGYKGRVFQVMFLPIQLINFLRMDDFAKHFNRYASMAIQQYLRVGYAEEVRYVQQLFGRVPTGEFPLHQMMLIRRDFPTRDRSIVEARVRRSGDENWQSWLLPMIIVREGLDHPDRWEWLIDYMDRKHTCQLCYLKHSKQIPTCGVIDVRASELTGCSPFKTVKIEEHVGNDSVFKTKLVRDEQIGRIGDHYYTTNCYTGAEALITTAIHIHRWIRGCGIWNDEGWQEGIFMLGRVLLRWELTKAQRSALLRLFCFVCYGYAPRADGTIPDWNNLGSFLDIILKGPELSEDEDERAYATMFEMVRCIITLCYAEKVHFAGFAAPACESGEVINLAARMSQMWMEY

SEQ ID NO: 7 - protein, 349 aa, artificial sequence
  VP7 of BTV1 ACR58464
MDTIAARALTVMRACATLQEARIVLEANVMEILGIAINRYNGLTLRGVTMRPTSLAQRNEMFFMCLDMMLSAAGINVGPISPDYTQHMATIGVLATPEIPFTTEAANEIARVTGETSTWGPARQPYGFFLETEETFQPGRWFMRAAQAVTAVVCGPDMIQVSLNAGARGDVQQIFQGRNDPMMIYLVWRRIENFAMAQGNSQQTQAGVTVSVGGVDMRAGRIIAWDGQAALHVHNPTQQNAMVQIQVVFYISMDKTLNQYPALTAEIFNVYSFRDHTWHGLRTAILNRTTLPNMLPPIFPPNDRDSILTLLLLSTLADVYTVLRPEFAIHGVNPMPGPLTRAIARAAYV

SEQ ID NO: 8 - protein, 354 aa, artificial sequence
  NS2 of BTV1 ACR58465
MEQKQRRFTKNIFVLDANGKTLCGAIAKLSSQPYCQIKIGRVIAFKPVKNPEPKGYVLNVPGPGAYRIQDGQDIISLMLTPHGVEATTERWEEWKFEGVSVTPMATRVQHNGVMVDAEIKYCKGMGIVQPYMRNDFDRNEMPDLPGVMRSNYDVRELRQKIKNERESAPRLQVQSVAPREESRWMDDDEAKVDEEAKEMIPGTSRLEKLREARSNVFKEVEAGINWNLDEKDEEDRDEREDEEQVKTLSDDDEQGEDASDDEHPKTHITKEYIEKVAKQIKLKDERFMSLSSAMPQASGGFDRMIVTKKLKWQNVPLYCFDESSKRYELQCVGACERVAFVSKDMSLIILPVGV

SEQ ID NO: 9 - protein, 329 aa, artificial sequence
  VP6/NS4 of BTV1 AEU03964
MSAAMLLAPGDVIKRSSEELKQRQIQINLIDWTEGESEKESKAEAKEGDKAEELKDGEGTQSESSQKKESSKETKDADVDRRIHTAVGSGSSAKGPGERANENVDRGDGKVGGGGGDADAGVGTTGANGGRWVVLTEEIARAIESKYGTKIDVYRDEVPAQIIEVERSLQKELGISREGVAEQTERLRDLRRKEKSGAHAKAAERGRRKQGKKPHGDAQREGTEEEKTSEEPASVGITIEGVMSQKKLLSMIGGVERKMAPIGARESAVMLVSNSIKDVVRATAYFTAPTGDPHWKEVAREASKKKNILAYTSTGGDVKTEFLHLIDHL

SEQ ID NO: 10 - protein, 229 aa, artificial sequence
  NS3 of BTV1 ACR58467
MLSGLIQRFEEEKMKHNQERVEELSLVRVDDTISQPPRYAPSAPMPSSMPTVALEILDKAMSNTTGATQTQKAEKAAFASYAEAFRDDVRLRQIKRHVNEQILPKLKSDLGGLKKKRAIIHMTLLIAAVVALLTSVCTLSSDMSVAFKLNGTSAEIPQWFKSLNPMLGVVNLGATFLMMVCAKSERSLNQQIDMIKKEVMKKQSYNDAVRMSFTEFSSVPLDGFELPLT

SEQ ID NO: 11 - protein, 961 aa, artificial sequence
  VP2 of BTV8
MEELAIPIYTNVFPAELLDGYDYIIDVSSRVEEEGDEPVKRHDVTEIPRNSMFDIKDEHIRDAIIYKPVNNDGYVLPRVLDITLKAFDDRKRVVLNDGHSEFHTKTNWVQWMIDDAMDVQPLKVDIAHTRSRISHALFNCTVRLHSKKADTASYHVEPVEIESWGCNHTWLSRIHHLVNVELFHCSQEAAYTLKPTYKIISNAERASTSDSFNGTMIELGRNHQIQMGDQGYQKLKEGLVQVRIEGKTPLVIQEEITALNKIREQWIARNFDQREIKVLDLCRLLSTIGRKMCNTEEEPKNEADLSVKFQMELDEIFRPGNNERTNIMGGGVHRKNEDRFYVLIMIAASDTNKGRIWWSNPYPCLRGALIAAEVQLGDVYNLLRNWFQWSVRPTYVPYDRNRESDKYIYSRINLFDSTLRPGDKIVHWEYKLLNEVREVSINKGNECDLFPEDEEFTTKFHEARYTEMKNQIIQSGWNQRDFKMHKILEDGANVLTIDFEKDAHIGTGSALSLPDYYNKWIIAPMFNAKLRITEVVIGTAHTDDPAVGRSAKAFTHDPFDLQRYCLARYYDVRPGMMGRALSKQQNMSSMTDKLSKQEDYAGIVSRRLEYKERENRCLTETAQYVFEKTCLYVLELLSRHTMPSEDSEVTFEHPTIDPSVDIETWKIIDVSQLIIFVFDYLFENRKIVRDTTEARWTLFKIRSEVGRARIDAIEMTFPRFGRMLRNASQAKINQDIACLNFLPLLFIIGDNISYAHRQWSIPVLLYAHDIRIIPLEVGAYNNRFGLTSYLEYMAFFPSYATRVAKIDESIKECAIAMAEFYMNTDIHSGSVMSNVITTKRLLYETYLASLCGGYSDGLLWYLPITHPSKCLVAFEVADDVVPLSVRRERILSRFPLSSRHVKGIALISVDRNQKVSVQTEGIVTHRLCKKNLLKYVCDVILFKFSGHVFGNDEMLTKLLNV

SEQ ID NO: 12 - protein, 526 aa, artificial sequence
  VP5 of BTV8 CAM57247
MGKIIKSLSRFGKKVGNALTSNTAKKIYSTIGKAAERFAESEIGSAAIDGLVQGSVHSLMTGESYGESVKQAVLLNVMGSGEELPDPLSPGERGMQTKIRELEDEQRNELIRLKYNDKIKQKFGKELEEVYEFMNGVAKQEEDEEKHYDVLKKAVNSYDKILTEEEKQMRILATALQKEVKERTGTEAVMVKEYRNKIDALKEAIEVERDGMQEEAIQEIAGMTADVLEAASEEVPLIGAGMATAVATGRAIEGAYKLKKVINALSGIDLTHLRTPKIEPTIVSTVLDHKFKDIPDEMLAVSVLSKNRAIEENHKEIIHLKNEILPRFKKAMDEEKEICGIEDKKIHPKVMMKFKIPRTQQPQIHIYSAPWDSDDVFFFHCISHHHANESFFIGFDLGIDLVHYEDLTAHWHALGAAQAAVGRSLNEVYKEFLNLAINNTYSSQMHARRMIRSKTVHPIYLGSLHYDISFSTLRSNAQRIVYDEELQMHILRGPLHFQRRAILGAIKHGVKILGTEVDIPLFLRNA

SEQ ID NO: 13 - protein, 962 aa, artificial sequence
  VP2 of BTV2 AEO19855
MDELGIPIYGRNYPEHLLKGYEFLINTGVRYPSQGGRHDVSKIPEMFAYDIKDEGIREALKYMPTRNDGVVLPRIVDISLKGYDIRKSVIEANKSNSFHTDTNWVQWMIKDSMDQQPLKISIDEEHSRVVHSLFNCQVKIDAKKADTLSYHLEAIEDAEKACLHTRGQLCNHLARMDLLHAAQEIAYAIKPTYQLIVHSERASTSDNFELGRQDVITLRRGHRIQMGDEAYTKLMERLVRLTVQGNVPRKIQSEIEQLEAIRTRWATGRYDPAHINSQDLCRILSRIGRIMLDQEAEPVDEDSLSLRFQRALDEKFRLNDSERNKIFEPKSHRKDEDRFYVLLAIAASDTYNSRIWWSNPYPCLRGTLIAAETKLGDVYFTLRSWYDWSVRSSYVPRERERETEKYIFSKINLFDYEAGPSSKVIHWEYQLYKRERVVTLERGNPCDLYPDEDDEVIITKFDDAKYSEMVGEIIDGGWNDEEFKMYKLLQEKGNVLTIDFEKDTKLNSTSEVVLPDYYGKWIVAPMFNSKMRIIETEIATNRSDDPMIKRTLKPMTDDPVELQRYTLARYYDIRPGLMGRSLNRTQTQSTFDAKVSELSDYEKVVSRFGVIKKPTRPCVTLTGRYILEKYSLLLIDILKYHTEVEENPQEEFTHPRIDSQFKFNGNTLSDLNQTVVFIVDYLHEKRNYVRSVYEARYIISRIRSSTGAARMSILEFYFPTFARLISNAREPTYVKDLMALNFLPLLFIVGDNMIYKHRQWSIPLLLYTDRVKVIPLEVGSSNNRQGLVSYLEYMFFFPSLADRTSKVDESMIKVSKEVVNYYMKTTISEGGVNLNVVSTKSLLYDIYLSSVCGGVSDGVVWYLPITHPYKCVVAIEVCDDRVPARLRCDRLRLRFPLSAQHLKGIVVIQINEEGGFDVYTEGIVTHRVCKKSLLKHVCDIVLLKFHGHVFGNDEMLTKLLNV

SEQ ID NO: 14 - protein, 526 aa, artificial sequence
  VP5 of BTV2 AEO19851
MGKVIRSLSRFGKKVGSALTSNTAKKIYSTIGKAAERFAESEIGSAAIDGLVQGSVHSILTGESYGESVKQAVLLNVLGSGEEIPDPLSPGEQGIQTKLKELEEEQRNELVRLKYNDKIKEKFGEELEQVYEFMSGAAKEEAGDEKQFDILSKAVNSYNKILTEEDLQMRRLAIALQKEIGERTHAETTMVKEYRNKIDALKSAIEIERDGMQEEAIQEIAGMTADVLEAASEEVPLIGAGMATAVATGRAIEGAYKLKKVINALSGIDLTHLRTPKIEPSVVSTILEYRAKDIPDNALAVSVLSKNRAIQENHKELMHIKDEILPRFKKAMDEEKEICGIEDKVIHPKVMMKFKIPRSQQPQIHIYTAPWDSDDVFFFHCISHHHANESFFIGFDLSIDLVHYEDLTAHWHALGAAQMAVGRTLTEAYKEFLNLAISSTYGTQMHTRRLIRSKTVHPIYLGSLHYDISFADLRGNAQRIVYDDELQMHILRGPLHFQRRAILGALKFGCKILGDRLDVPLFLRNA

SEQ ID NO: 15 - protein, 526 aa, artificial sequence
  VP5 of BTV2 south africa CAE53012
MGKVIRSLSRFGKKVGSALTSNAAKKIYSTIGKAAERFAESEIGSAAIDGLVQGSVHSILTGESYGESVKQAVLLNVLGSGEEIPDPLSPGEQGMQTKLKELEEEQRNELVRLKYNDKIKEKFGEELEQVYEFMNGAAKEEVGDEKQFDILSKAVNSYNKILTEEDQQMRRLAIALQKEIGERTHVETAMVKEYRNKIDALKSAIEIERDGMQEEAIQEIAGMTADVLEAASEEVPLIGAGMATAVATGRAIEGAYKLKKVINALSGIDLTHLRTPKIEPSVVSTILEYRAKDIPDNALAVSVLSKNRAIQENHKELMHIKDEILPRFKKAMDEEKEICGIEDKTIHPKVMMKFKIPRSQQPQIHIYTAPWDSDDVFFFHCISHHHANESFFIGFDLSIDLVHYEDLTAHWHALGAAQMAVGRTLTEAYKEFLKLAISSTYGTQMHTRRLIRSKTVHPIYLGSLHYDISFADLRGNAQRIVYDDELQMHILRGPLHFQRRAILGALKFGCKILGDRLDVPLFLRNA

SEQ ID NO: 16 - protein, 959 aa, artificial sequence
  VP2 of BTV3 CAE51090
MEELVIPVISRQFDKKLVGRYEYVIELAEPEQDEWTNHDVTQIPGRRMFDVAQQGIREAIIYKPLDNDGEVLPRILDMSIACYDMRKTMMKKEGVDFVSNTRWLEWMIQDSMDVQPLRVQMKEDHSTVQYDMFSAKVHIDSRKADTTSYHAIAVETKAERKCCHVRTEVWNSVVRNHLFNTAQESCYTFKQTYELIVNSERLSTEEEFRVGAPQFHTIQRNHRMQLGDNAYDKFLKGLVQLRVSGTTPAKIRDEVAALDVIRDNWIRGSFDRSHIKSLELCRLLSSIGRKMVNMEEEPKDEKDLSVKFQFRLDEKFSPNDPERNVIFTSKTHRTNEDRFYVLLVIAASDTNNGRVWWSNPYPCLRGALIAAECKLGDVYHTLRSKYEWGVRPTYKPKDLEREREKYVVGRVNLFDLEGEPATKVIHWEYELISPTYSVSNHKGNHCDLYPDDVEITTKFNEDRYREMIQSVIDDGWDQKNLKMYKILEEEGNPLLYDLEKDIKLDSQSQVVFPSYYNKWTHAPMFNARVKPCDIELAERKNDDPFVKRTLKPIKADCVDLLRYHMSHYYDLRPSLKGVSLSNKQTPSGIHQALVQDDLYSRLLRRRDVDLDYSSPCPIITNYFLLEKFHILILTIMEKHYWELDDSDDVYEFPKIDASAFEVDGTLYDISQTIVHMYDRFFEKRRVLRSIDESRWILHLIRISQGRERLEVIERFFPNYGKAMRQRDFKKVRDVMFLNFLPFFFLTGDNISYEHRQWSIPIILYADKLRILPIEVGAHYNRFGVTCILELLNFFPSYEKREEKLEEDIVLCADAIVNFYLQTTISNGGVQTSIVSTKALLYEMYLSSICGGYSEGVLWYLPITHPVKCLVALEVSDALVGADVRIDKIRRRFPLSAKHLKGIVQISVHPNRTFSVTTCGIVKHKVCKKTLLKHRCDVILLQTPGYVFGNDELLTKLLNI

SEQ ID NO: 17 - protein, 526 aa, artificial sequence
  VP5 of BTV3 CAE53013
MGKIIKSLSRFGKKVGNALTSNTAKKIYSTIGKAAERFAESEIGSAAIDGLVQGSVHSIMTGESYGESVKQAVLLNVLGAGDEIPDPLSPGERGIQMKIKEIEEEQRNELVRLKHGKEIAKKFGDELEEIYQFMNGEVKEEVQQEEQYKVLCKAVNSYEKLLLAENDEMRTLARALQREATERTETESKMVKEYRQKIDALKAAIEVERDGMQEEAIQEIAGMTADVLEAASEEVPLVGSGMATAIATGRAIEGAYKLKKVINALSGIDLSHLRTPKIEPTMVATTLEHRFRDIPDKELAVSILAKNNAIVANTREVQHIKEEILPKFKKIMDEEKELEGIDDKKIHPRVMMRFKVPRPQQPQIHIYSAPWDSDDVFFFHCVSHFHVNESFFLGFDLGIDVVHFEDLAAHWHALGAAQEAKGRTLNEAYKEFLNLSIGSAYTSPMHARRMIRSKTVHPIYLGSMHYDITYETLKSNAQRIVYDDELQMHILRGPLHFQRRAILGALKFGVKVLGDKIDVPLFLKNA

SEQ ID NO: 18 - protein, 956 aa, artificial sequence
  VP2 of BTV4 ABB71699
MEEFVIPVFSEREIPYALINRYPLAIQTDVKIADVEGYHNLAKIPESDMVDVPKLDIVSALNYKPTRNDGIVVPRLLDITLKAYDDRKSVKNARGVDFMTDAKWMKWAIDDRMDIQPLKITLDEHYAVNHQLFNCIVKAKTANADTIYYDYFPLEDRAKKCNHTNLELLRSLTTIEAFHVLQGAAYSLKSNYDLIANSERESLEESYPIGSEKWVHLIRRTKIGNSGLSYNRFISSMVQVVVRGKVPDIIRGEITQLNRIRTEWISASYDRTRIRALELCNILSAIGRKMMDAHEEPKDEMDLSTRFQFKLDEKFNTSDSEHVNIFRTSGAATNEGRFYALIAIAATDTQKGRVWRTNPYPCLRGALIASECELGDVYYTLRHVYRWSLRPEYGQRERQLEDNKYVFGRVNLFDSDLAVGDQVIHWRYEITEPVKTTYDNGYICNPEEKDDELLCKIDDERYKEMMERLIEGGWDQERFKLHNILTEPNLLTIDFEKDAYLNSRSELVFPNYFDKWINSPMFNARLRITHGEIGSSKTIDPWNRRVVYGYIKTSIESLDYTLGKYYDIRLQLFGDTLSQKQTQSAVFTYLSGQDDFPALTNYLKGEAVCPHAGGAVYTFRKMALSLIASYEKLSPEMHEGLEHQTYVHPSVNTAYQKQVKDMKDLSQLICFIIDCIFEKRVQIRGVGEARRIVYLIQNSTGLQRQEVLKRTFPNFLMRLFKLREVKRICDLNVINFLPLLFLVQDNISYWHRQWSVPMILFDDAVRLIPVEVGAYANRFGFKSFYNFIRFHPGDSKKKQDADDMHKEYGVACFEYYMNTKISQGGVNVPVVTSKLDTLKIHLASLCSGLADSIVYTLPVAHPKKCIVLIVVGDDKLDPQVRSEQVLSKYYYSRRHICGVVAVSVGQEGQLQVYSTGIVRHRICEKSILKYKCKVVLVRMPGHVFGNDELMTKLLNV

SEQ ID NO: 19 - protein, 526 aa, artificial sequence
  VP5 of BTV4 CAE53015
MGKIIKSLSRFGKKVGNALSSNTAKKIYSTIGKAAERFAESEIGAATIDGLVQGSVHSIITGESYGESVKQAVLLNVLGTGEELPDPLSPGERGMQTKIKELEDEQRNELVRLKYNKEITKEFGKELEEVYDFMNGEAKEEEVVQEQYSMLCKAVDSYEKILKAEDSKMAILARALQREASERSQDEIKMVKEYRQKIDALKDAIEIERDGMQEEAIQEIAGMTADVLEAASEEVPLIGAGMATAVATGRAIEGAYKLKKVINALSGIDLSHMRSPKIEPTIIATTLEHRFKEIPDEQLAVSVLNKKTAVTDNCNEIAHIKQEILPKFKQIMDEEKEIEGIEDKVIHPRVMMRFKIPRTQQPQIHIYAAPWDSDDVFFFHCVSHHHRNESFFLGFDLGIDVVHFEDLTSHWHALGLAQEASGRTLTEAYREFLNLSISNTYSSAIHARRMIRSRAVHPIFLGSMHYDITYEALKNNAQRIVYDEELQMHILRGPLHFQRRAILGALKFGVKILGDKIDVPLFLRNA

SEQ ID NO: 20 - protein, 955 aa, artificial sequence
  VP2 of BTV5 CAE51092
MDEFGVPIFRSSQVPHHILEGYDIKVDLSDRVVQEDGRHDPNKLKERKTIDVPNGEARSDLNYNPTDNEGNQLPRALDIALCARLTRKSFNTNSGVTFHTDHKWMEWMLSDAMDVQPLRIDLAAQNEYAKCDLFNSSVYVRKKYVDAISYRYISVEDDSKGCNHTRVYSVNHMINCGLYNVAQECAYAFKHTNTLIVNSQRETTSEPFQPGNPKIGSLGRRARVDMADPGYPLFRAGLLQIIVNGAIPADIRSEMDRLNQIREAWKRDKNTREVRALDLCVLLSKIGRIKMNMEEEPKDEGVMSLRFQGKIDAMFFSENTEKTNIMRDGSGRTDDERFYALLLICATDAFSRRIWRTNPYPCLRGTLIAAECVLGDPYKTLRRKFDWSVRHAGDKMLEGSSYVFTRINLFDTDKAPGSRVIHWIQETLPVIKTTWAEGCSLADEASDDHLHCKIDHAQYRDLVSRVINGGWDQENFKIHKLFVERGNIFLMDFEKDAKITTQSEVEYPYYYDTWIYAPIFSTRYKITETEIANAKSLDPAIKRTLAPLSDDPVALQLRAVGHLYDTRPAIMGQTLSPRQNQTALHKTLLDDPENDRYYEARSIKKVDNPCSVHYTSSFILQKISELVLSLMIYHIEHDWEPLKQYTHPEISTEFGEISCEICDISQLTVLLIDLFFENRRTVRPSEETRYIIHQIRESRGDGRLKMLERFFPAYGQALRKIESATEVGHITMLNFLPFFFLLGDNIIYKHREWTVPILIYTDGVMIWPAQVGANYNRFGFCGFLNYMRFHAGSQLRSKVLDDAEKTIAKEMLKYYMKTDIFSGGVQKNIRVTKSMQMEIYHSSLCGGLSDAVVYALPISFPIKCLTLIIIGDDLVEPQLRISRVMDYFKHVSEHVRGVASISISRNGDVSTYSRGIVHVELLKKNILKYQFQVALLKVKGYVFGNDEMLIKLLNV

SEQ ID NO: 21 - protein, 526 aa, artificial sequence
  VP5 of BTV5 CAE53016
MGKIIKSLSRFGKKVGNALTSNTAKKIYSTIGKAAERFAESEIGSAAIDGLVQGSVHSIMTGESYGESVKQAVLLNVLGAGDEIPDPLSPGERGIQMKIKEIEEEQRNELVRLKHGKEITRKFGAELEEIYQFMNGEMREEAEQEEQYKVLCKAVNSYEKLLVAENDQMRALARALQREATERTEAESTMVKEYRQKIDALKAAIEVERDGMQEEAIQEIAGMTADVLEAASEEVPLVGSGMATAIATGRAIEGAYKLKKVINALSGIDLSHLRTPKIEPTMVATTLEHRFDEIPDKELAVSILAKNNAIVANTREVQHIKDEILPKFKKIMDEEKELEGIDDKKIHPRVMMRFKVPRSQQPQIHIYSAPWDSDDVFFFHCVSHFHANESFFLGFDLGIDVVHFEDLAAHWHALGAAQEAKGRTLSEAYREFLNLSIGSAYTSPMHARRMIRSKTVHPIYLGSMHYDITYETLKSNAQRIVYDDELQMHILRGPLHFQRRAILGALKFGVKVLGDKIDVPLFLRNA

SEQ ID NO: 22 - protein, 955 aa, artificial sequence
  Vp2 of BTV6 CAE51093
MDELAIPIINGHFPKEALIEYDCIVELNAPSEDDEVDVTQIPTKNMMDIPDVPIREALRVLPQRNDGHVLTRILDISLSGYDRRKYYKTNKGGEFESPKEWLNWMIHDSMDVQPLKVSLEMRPTVKHELFSSNVYLSVKKADTSSYHIEAIGDTGKACDHSYVSMWNNLVRHEVMHCAQESAYVLKPTMEIIVHSERASTDVPFQLVGQNYVSIGRNHRLVLGDEPYKKTLQGLTKLRVQGKVPPQIQDEIQQLNRIRDAWIGDAYNPRHIRSLELCRILSSVGRKVVCIEEEPKNESDISVKFQFKLDEKFRLNDGERGVIFTSKNQRNDQDRFFVLIMIAASDTYNGRIWWTNPYPCLRGALIASETRLGDVYWTLRHTYDWSVRMTYSPRMKEREDDKYIYGRVNLFDLDASPGDKVVHWRYELISQTKKTTFHDGNPCDLFPDVEGIVTKFNKTAYSNMINELLNGGWNTREFKMYKLLEDEGNVLTIDLEKDTKLNSRSEFILPNYYDKWIYAPMFNAKLKITETEIAQAKNDDPYVIRTLAPIGSNPFTLQRLCLGNYYDVRPAMHGRALSKKQEQSAYHAALVKEKDYEDILTRRGLRKADKPCPLTTCAYILEKTALLWIDVMEKHISEVTDDSNEFDFPKACVDSPVGTDRIVDVTQLIVLLIDWIYERRKDVRSVDESRWVIETIRRARGRNRLELISREFPNFGRAVARLQSPNTVGDVMVINFLPFLFLMGDNVSYEHRQWSVPVILHADVMWFIPVEVGAFYNRFGVTSFLEYLMFFPSFHMRTVRLDEAEVKVSKLILDFYLDTTIFSGGIQSSVVSTKQILYETYLSSLCGGFSEGLVWYLPITHPTKCVVAIEFADNKVSAVYRCNRLRARFPLSSIHLRGIAILTIGKNRMVDAYTEGIVSHRICKKNVLGYTCQILLLKFSGHVFGNDEMLTKLLNV

SEQ ID NO: 23 - protein, 526 aa, artificial sequence
  Vp5 of BTV6 CAE53019
MGKIIKSLSRFGKKVGNALTSNTAKKIYSTIGKAAERFAESEIGSAAIDGLVQGSVHSIMTGESYGESVKQAVLLNVLGAGDEIPDPLSPGERGIQMKIKEIEEEQRNELVRLKHGKEIAKKFGDELEEIYQFMNGEVKEEVQQEEQYKVLCKAVNSYEKLLLAENDEMRTLARALQREATERTETESKMVKEYRQKIDALKAAIEVERDGMQEEAIQEIAGMTADVLEAASEEVPLVGSGMATAIATGRAIEGAYKLKKVINALSGIDLSHLRTPKIEPTMVATTLEHRFRDIPDKELAVSILAKNNAIVANTREVQHIKEEILPKFKKIMDEEKELEGIDDKKIHPRVMMKFKVPRSQQPQIHIYSAPWDSDDVFFFHCVSHFHVNESFFLGFDLGIDVVHFEDLAAHWHALGAAQEAKGRTLNEAYKEFLNLSIGSAYTSPMHARRMIRSKTVHPIYLGSMHYDITYETLKSNAQRIVYDDELQMHILRGPLHFQRRAILGALKFGVKVLGDKIDVPLFLKNA

SEQ ID NO: 24 - protein, 959 aa, artificial sequence
  Vp2 of BTV7  CAE51094
MDEFAIPIVHGRVIPYDLVRSYDIVVDLDVRIDEEGDKHDTTKIPEAYMCDVPNIAMQDANSAILGRNDGYALPRILDVSIAAYDPRKGYWKYRGIEKMTNQTWLKWAIKDFMDVQPLKVDLADLEGKVRYDMFNCSARIDAKKAEAIYYGWAAQEVVNKGCNHAKSEMFQHVVRCELLNCSQESAYILKPTQKIEPLAEKNDLGERLGPGSNNLINMRRGDTFRMGTDQYNRMLQGWYRVKVKGQIPDMVREEMAELVKIRDRWKVAKNPREIKSLELCKLLSTIGRRMYNMYEEPKDEEAVSLRFQWNLDEIFKTDNREHVNIAVNKNGRTDDERFFALIMIAATDTNRGRIWWSNMFPCLRGALIASETQFGDVYKMLRVRFEWSVRNEYSPQADVARQNENYVYARVNLFDLVADPATSVIHWEYKLDKPFKTCYSDGHQCDEYPDEYDLICSFDEAKYSEMVQRIIEGGWDHKNFKHYKILKEASNVLTIDFEKDAKLNESSEMNLPYYFNKDIAAPMFRCVLKVCETSISERHNLDPAISRTMKPMRAKAADLLDYSLGSYYETRSGVMGRTLTTTQKQSDMYKMVQDEDDYLSLMVGRGVTDKFANPCPITTAGQYALQKTSVMIFSRVEHYFEEYLKDDKVEYLSPSLNLEWVEITSRITDISQLIVLTFDVFFEGRRQVRTIDESRFILYQIRARKGMDRLSYIKDLFPQLYGWWVSPEPTYGHAQKLNLLPLLFIIGDNFIYEHRQWSYPVILVSHKLRFVPVELGAYYNRFGLTSLFSYLVFHVGKSKYGLELDEAEKKVLQAAKDYYAVATISEGGINTHSTMTKDPIYQVYLSTICGGLLDSLIYLMPITHPVKSIIMVIINDGRGSASDCVRRATRRLRYIQRHIRGSVVVSVLRDGVINTYSEGIAKAMLCEKSVLKYNYKVVLVKVKGYVFGHDEMLTKLLNV

SEQ ID NO: 25 - protein, 526 aa, artificial sequence
  VP5 of BTV7 CAE53020
MGKIIKSLSRFGKKVGNVLTSNTAKKIYSTIGRAAERFAESEVGAATIDGIVQGSVHSIMTGESYGESVKQAVLLNVLGSGEELPDPLSPGERGIQTKLKELEDEQRNELVRLKLNKKIVDKFGTELEEVYDFMNGAAKDDENEIKQYDILCKAVDSYGKILREEDKKMLELARALQRESESRSDEETKMVREYRSKIDALRDAVDVERESMTEEAIQEIAGMTSDVLEAAAEEVPLVGSGMATAIATGRAIEGAYKLKKVINALSGIDLTHLRTPKIEPSLIATTLEYRDRPIPDDSLAVSVLEKRRAIEENKNEIEHIKNEILPRFKKAMEEEKEISGIEESVIHPKVMMRFKIPRSQQPQIHIYCSPWDSDTVFFFHCVSHHHMNESFFIGFDLELDLVHFEDLTAHWHALGAAQMVVGRTFQEAYREFLGRAMMDPSSGAMHKRRMSRSRSVHPIYLGSMHYDISYATLKSNAQRIVYDDELQMHVLRGPIHFQRRAILGALKHGIKILNDKIDLTSLLRNA

SEQ ID NO: 26 - protein, 955 aa, artificial sequence
  VP2 of BTV9 south afria AEO19747
MDEFGIPLYRSTHVPHHVLEDYELRIDLSDRVVHGGDRHDPKKLKERKAIDVPDGDVRLDLNYNPTDNEGNQIPGALDIALCARITRKSVKTNEGVTFTTNHKWMEWMLLDAMDVQPLKIDFAALGGAVKCDLFNSAIYVKKKHADAIMYRYIAVEDESRGCNHSRVQDVNHLINNGLYNVAQECAYAFKDTYVLRVHSQRENVEEPFEIGRPKVGSLGRNAVISMENPGYPLFRAGLLQITVSGTIPADINDEMNRLNQIRSAWIRDKATREVKAIELCTLLSRIGRLKMDMEEEPKDEGAMSLRFQGKIDTMFFSENTEKTNIMRNISGRTDEERFYVLLLICATDAYTRRIWRSNPYPCLRGTLIATECVLGDAYKTLRQKFDWSVRHAADKAIENFSHIFTRINLFDTGKTPGARIIHWVQEMTMGTKTSWESGYPLKDEAPDDELHCRVDRDQHRQMVTRIIDGGWDHENFKIHKLFHEQGNIFLMDFEKDARLTSRSEVEYPYYYDRWIYAPIFDTRYKIMETEIATAKNADPAIKRTLAPLMDDPVMLQLRTIGNLYDTRPAIMGSTLSARQAQTSLHKTLLDEAENGRYYRSRGLEKRANPCSVCYTSSFVLQKVSELVLSLMIYHVDHDWEPLKQYNHPDVLSEFSETVREIHDISQLIVLLVDLFFEQRRTVRPVEEARYVIYSIRVARGADRLDTFRRFFPAFGRALDVVNRATDVAHITALNFLPFFFLLGDNIIYKHREWTVPVLIYTEGVMIWPAQVGANFNRFGFCGFLNYMRFHAGSRLRAKPLDDAEKIVTREMLRYYMKTDIFDGGVQKNIRVTKSSQMEIYHSSLCGGLSDAVVYVLPISFPIKCLTLIIVGDDLVEPQMRFGRVMDFFRHVAEHVRGVASISISRNGDITTHSQGIVRVELLKKNILKYQFQVALLKVKGFVFGNDEILIKLLNV

SEQ ID NO: 27 - protein, 526 aa, artificial sequence
  VP5 of BTV9 south africa CAE53024
MGKVIRSLSRFGKKVGNALTSNTAKKIYSTIGKAAERFAESEIGSAAIDGLVQGSVHSIITGESYGESVKQAVLLNVLGSGEEIPDPLSPGERGIQTKLRELEDEQRNELVRLKYNDEIKRKFGEELEQVYDFMNGVAKDEEGEEKQFDILNKAVNSYDKILAEEDTQMRRLATALQKEIGDRTHTETTMVKEYRSKIEALKNAIEVERDGMQEEAIQEIAGMTADVLEAASEEVPLIGAGMATAVATGRAIEGAYKLKKVINALSGIDLTHLRTPKIEPSVVSTILEYRARDVPDKALAVSVLSKNRTIQENHKELIHIKDEILPRFKKAMEEEKEICGIEDKTIHPKVMMKFKIPRTQQPQIHIYSAPWDSDDVFFFHCISHHHANESFFLGFDLSIDLVHYEDLTAHWHALGAAQTAAGRTLTEAYKEFLNLAISNNYGTQMHTRRMIRSKTVHPIYLGSLHYDVSFADLRGNAQRIVYDDELQMHILRGPLHFQRRAILGALKFGCKILGDQIDIPLFLRNA

SEQ ID NO: 28 - protein, 955 aa, artificial sequence
  VP2 of BTV8 Italy AEO19795
MDEFGIPIYLSSSVPHDLLSDYDFMIDLSDKVVHAGDRHDPKKLKERKAIDVPDGEARTDLNYNPTDNEGNQLPRALDIALSARLTRKSVRNNDGLDFLTDDKWMEWMLSDAMDVQPLKIDLSARNGFVKCDIFNSSIYIRRKYADAIAYRYTSLEDESKGCNHTRVCMVNHLINNGLYNAVQECAYALKDTYVLRVHSQRERIDEPFEPGRPKIGSLGRNARIDMSDPGYSLFKGGMLQITVSGEIPNDIRVEMERLNQIRATWIRDKSSREVRAIELCTLLSRIGRVKWNAEEEPKDEGAMSLRFQNKIDSMFLSENTEKTNIMQNTSGRTDEERFYALLLICATDAYSRRIWRSNPYPCLRGTLIAAECVLGDPYKTLRRKFNWSVRHAADKALENNAYIFTRINLFDTERTPGMRVVHWTQELTMESQTTWDEGYPLKDEAPDDEMHCKIDTNKYKEMVTQVIDGGWDQENFKIHKLFHDDGNIFLMDFEKDAKLTAQSEVQYPDYYDKWIYAPIFDTKYKITETEIANAKNLDPAIKRTIDPMMDDPVMLQLSTIGNLYDTRPAVMGSTLSMRQRQTSLHKTLLDDPQNERFYSSRSIKKVDDPCPVYYTASLVLQKISELVMSLMIYHVDQDWESLKQYKHPSILSDFSSLVSNIQDISQLVVLLVDFFFERRSVLRSVEESRYIIHIIRSSNDANRLKSFELYFPRFGGILRTIKDAKEVSHVTALNFLPYFFLLGDNIIYKHKEWSVPVLIYSDGLMIWPAQVGANFNRFGFFGFLNYMRFHPGIRLRSKVLDDAEKVVAVEMLNYYMRTDIFKGGIQKNVRVTKLSQMEIYHSSLCGGLSDALIYALPISFPIKCLTLIIVGDDLAEPQHRISKALEFFEHVRDHVRGIASISISRNGDVTTHSQGIVKVELLKKNILRHQFRVALLKVKGYVFGNDEMLTKLLNV

SEQ ID NO: 29 - protein, 956 aa, artificial sequence
  VP2 of BTV10 CAE51097
MEEFVIPVFSERDIPYSLLNHYPLAIRIDVKVDDEDGRHNLIKIPESDMIDVPKLSVIEALNYRPKRNDGVVVPRLLDITLHAYDKRKSTKSAKGVEFTTDAKWMKWAIDDKMDIQPLKVTLDNHYSVNHQLFNCIVKARSANADTIYYDYYPLENGAKKCNHTNLDLLRSLTTTEMFHILQGAAYALKTTHELVAHSERESTSETYQVGTQRWIQLRKGTKIGYRGQPYERFISSLVQVIIKGRVPDEIRDEIAELNRIKDEWKNAAYDRTKIRALELCKILSAIGRKMLDVQEEPKDEMALSTRFQFKLDEKFIRTDQEHVNIFEVGGPATDDGRFYALIAIAATDTQQGRVWRTNPYPCLRGALIAAECELGDVYFTLRQTYKWSLRSEYGQRERPLEDNKYVFSRLNLFDTNLAIGDEIIHWRYEIYRPKETTHDDGYICVSQKDDDELLCEIDGDRYKEMFDRMIQGGWDQERFKLHNILTEPNLLTIDFEKDAYLGSRSELVFPPYYDKWINSPMFNAKLKIARGEIATRKVDDPWNNRAVHGYIKTSAESLGYVLGPYYDLRLQLFGDALSLEQKQSAVFEYMAQQDDFPALTDYTKEKNGCPHSGGTFYTFRKVALIILSSYERLDPSLHEGREHETYMHPAINDVFRRYALEMKEFSQLICFVFDYIFEKHVQLRNAKEARRIIYLIQNTSGVHRLDILRETFPNFLRHVMNLRDVKRICDLNVINFFPLLFLIQDNISYWHRQWSIPMILFGEVVRLIPIEVGAYANRFGFKSFLNFIRFHPGDSKKKQDADDTHKEFGSICFEYYTTTKISQGEIDVPVITSKLDTLKLHIASLCAGLADSLVYTLPVAHPKKSIVLIIVGDDKLEPQVRSEQIVNKYHYSRRHISGVVSICVDQNGQLKVHSMGITRHRICDKSILKYKCKVVLVRMPGHVFGNDELMTKLLNV

SEQ ID NO: 30 - protein, 526 aa, artificial sequence
  VP5 of BTV10 CAE53025
MGKIIKSLSRFGKKVGNALTSNTVKKIYSTIGKAAERFAESEIGAATIDGLVQGSVHSIITGESYGESVKQAVLLNVLGTGEELPDPLSPGERGMQMKIKELEDEQRNELVRLKYNKEITEKFGKELGEVYDFMNGEAKEVEAVEEQYTMLCKAVDSYEKILKEEDSKMAILARALQREAAERSEDEIKMVKEYRQKIDALKSAIEIERDGMQEEAIQEIAGMTADVLEAASEEVPLIGAGMATAVATGRAIEGAYKLKKVINALSGIDLSHMRSPKIEPTIIATTLEHRFKDIPDEQLAVSVLNKKTAVADNCSEIAHIKQEILPKFKQIMNEEKEIEGIEDKVIHPRVMMRFKIPRTQQPQIHIYAAPWDSDDVFFFHCVSHHHRNESFFLGFDLGIDVVHFEDLTSHWHALGMAQEASGRTLTEAYREFLNLSISSTFSSAIHARRMIRSRAVHPIFLGSMHYDITYEALKNNAQRIVYDDELQMHILRGPLHFQRRAILGALKFGVKILGDKIDVPLFLRNA

SEQ ID NO: 31 - protein, 956 aa, artificial sequence
  VP2 of BTV11 CAE51098
MEEFVIPVYSETDIPYSLLSHYPLAIRTDVKIADTDEGHDVVKIPESDMIDVPRVDIVEALAAKPMRNDGIVVPRLLDITLRAYDDRKAIKSARGVEFMTNAKWMKWAIDDRMDIQPLKVAIDHYNAVNHQLFNCIVKARSANADTIYYDYFPLESKVKKCNHANLDLLRSLTNTEMFHMLQGAAYSLKSNYELITNSERNSTEETYAPGVHNQIRLVRGTRIGYKGEAYSRFVSSLVQVRIQGRTPPEIVDDIARLNVIRTEWINAQFDSTKIRALELCKILSAIGRKMLNTHEEPKDEMDLSTKFQFKLDDKFKKTDSEHINIFNVRAPATHEGRFYALIAIAATDTQRGRIWRTNPYPCLRGALIAAECELGDVYHTLRQVYKWSLRQDYGRTEVPLENNKYVFSRINLFDSNLDVGDQVVHWMYEVDGPAETTYDNGYMCKTEREDEELVCKISEEKYKTMLDRMIQGGWDQERFKLYSILTDPNLLTIDFEKDAHLNIRSEFVLPSYFDQWIYSPMFNARLRITHGEIATRKSADPWNKRVVFGYIKASTESPEYALGQYFDMRIQFYGDALSSKQNQSAVFQYLSQQEDFPTLTSYAKGDVVCPHSGGALYTFRRVALMLMANYEKLSPDLHEGMEDYTYTHPSIGGAYQKRILEMRDFSQLICFIIDYIFERHDQLRDAKEARRILYLIQNLDEPQRLEMLNVTFPNFFRHFLKLKDVQLISDLNVINFLPLLFLVQDNISYWHRQWAVPMILYDDVIRLIPVEVGAYANRFGIKSFFNFTRFHPGDAKKRQKADDTHKEFGSISFNYYASTKIAQGGVHTPVVTTKLDTLKIHLSSLCAGLADSIVYTLPVAHPKKCIVLIIVGDDKLEPHVRSEQVVSKYYFSRRHVSGIVSICVGQDNQLKVYSSGIVRHRVCEKFILKYKCKVVLVKMPGYVFGNDELMTKLLNV

SEQ ID NO: 32 - protein, 526 aa, artificial sequence
  VP5 of BTV11 CAE53026
MGKIIKSLSRFGKKVGSALSSNTAKKIYSTIGKAAERFAESEIGAATIDGLVQGSVHSIITGESYGESVKQAVLLNVLGTGEELPDPLSPGERGMQTKIKELEDEQRNELVRLKYNKEITKEFGKELEEVYDFMNGEAKEEEVVQEQYSMLCKAVDSYEKILKAEDSKMAILARALQREASERSQDEIKMVKEYRQKIDALKNAIEIERDGMQEEAIQEIAGMTADVLEAASEEVPLIGAGMATAVATGRAIEGAYKLKKVINALSGIDLSHMRSPKIEPTIIATTLEHRFKEIPDEQLAVSVLNKKTAVTDNCNEIAHIKQEILPKFKQIMDEEKEIEGIEDKVIHPRVMMRFKIPRTQQPQIHIYAAPWDSDDVFFFHCVSHHHRNESFFLGFDLGIDVVHFEDLTSHWHALGLAQEASGRTLTEAYREFLNLSISSTYSSAIHARRMIRSRAVHPIFLGSMHYDITYEALKNNAQRIVYDEELQMHILRGPLHFQRRAILGALKFGVKILGDKIDVPLFLRNA

SEQ ID NO: 33 - protein, 950 aa, artificial sequence
  VP2 of BTV12 CAE51099
MEDFPICVIERESKFDEDFVVRYPVIIDLKECVDDVNGKTDVSKLEETRGIFVRAEGIRVALNSRPDNLSHVITPSALDVLIRAYDRKHKIALDKRTDDSGRMADHNIDVWVKKRLEEQADLQAIYHDVDLGRGKLKFKMLTGLVKLDSNYAETVGYDYAPVPKVGCDHGNVDFLYDFILSGSLQVSKTAGYTLKQTYRLTVHAEANAETRDQLIVNGVYTEGVTRGEEIRDMKKMCYSRFRDGWIRATIQPKIVEELRRSKEALDRISSEWYEKLTTPDVVEICKIVSSIGRQMWNSEELPVDDAMRSKVFQEELRLLFRVGNSEYDTIQAIQSGQTPLKKFYALLAIAATDSYRWRIWWSNPYPCLRGTIIACEMELGDVYETLRSTFHWSLRPTYATRKEIDRERRAYPYQRINLFESRLDPGTRIINWLVVREPLAEPDVKSGRVCMTSTESEYILKVDDTKYREMIGQIIERGWEKEHLKLEKIVQDEGNVFQMEFEKDASLDERSHLVMPYYYDKEIHCPMYHKKIKITEAEIATSWSDDPWLNRVLNGFLGDHVETFNLGCNHIFDMRVPLKGNLLTQEQAISSYHEHIRSPEAQSENQCALKVYADEAVSKLFTTLYHRLAYHLPKTEYIEREEEVSQYEGLVKRIRTWDQFIIFVFDFFFENRKGLRTTEEATQLAKAIRSNVGATRWTMMASAFPTSVRLVKGILRAKTWGECYIMNFLPLLICGGSSISYLHREWSYHMIVVFEDGIKVVPAMTGRSLTQGSLGEWASFVCFFMGSNHEKIKLEEDELEVLRKCVEFYEGVKMVDIIKDTPVRMTKYIACDLAFGSGCGGTSESLSFILPVTHPNRSLIIFVVADDKISPAQHAARAKRRFRGTREYVNDVIVLQMKRPGTVGNVWSEKHSKVRICRRNFLKYDHKVVLTKFAGLVYGNYELITKLANL

SEQ ID NO: 34 - protein, 529 aa, artificial sequence
  VP5 of BTV12 CAE53027
MMGKIIKSLGKFGKKVGNALTSKTAQKIYRTIGSAAERFAESEIGSAAIDGLIQGSVHSIMTGDSYGESVKQAVILNVLGGGDTIADPLSPGENEIYRKLKQLEDEQKGEIVRTKHNTEILKKFGNDLDEVYKFATQEHKVGEHEEDQIKMLEKALKSYIGVFKAENDSIDKLKKALYVESTERTEEETKMISEYRDKIDALRSAIEVEKEGLQEEAIQEIAGMSAEVLEAAAEEVPLFGAGVATSIATARAIEGAYKIKAVISALTGIDLTHLNVPKVQPKTLEAILDVPKGVDIPDLRLTEGLIAKMDKISENISEVDHIQNVIVPKLKKAVEEDKENITDWSEKRIHPKTAQRFKIPQTQKPSMHIYAAPWDSDEVFIFHVISPHHKNESFFLGFDLEIEYVFYEDLTQHWHALGTAQSTYGRTFREAYKEFFLLASNVAGQTAIHQRRLLRSRSNHPIYLGMHDYEVSYAQMKMNAMALVSNEDLQMHILRGPIHFQRRTIVAALKYGIKILTQPDDVSIMLRNA

SEQ ID NO: 35 - protein, 959 aa, artificial sequence
  VP2 of BTV13 CAE51100
MEELVIPVITERFDKRLVGRYDYVIELARPEGDEWSGHDVTHIPDKRMFDIKVQPIRDAIDYKPVENDGEVLPRILDMSIACYDMRKRMMKRDGVDFVSNTKWLEWMIQDSMDVQPLRVDMKEDHSTVQYDMFSAKLHVDSRKADTTSYNILALEVKKGAQCHHVHANIWNHMIRNHLFHAVQESCYIFKPTYKLIVNSERRTPDEDFQIGNPQFPTLRRNQQIFLGDDAYKKTARGLVQVLVNGVVPDIIRNEIAALDAIRDRWIQGNYERTHIKSLELCNLLSAIGRKMVNLEEEPKDERNLSLRFQHKLDDKFAKNDQERNVIFAQKSQRNDQDRFYVLMVIAASDTNNSRVWWSNPYPCLRGALIAAECKLGDVYYKLRSWYEWSVREGYKPRDLDRQYEKYIVGRVNLFDLEAEPGTKVLHWEYELISKLYIVSNHEGNQCDLYPDEGEIVAKFDDARYSDMIQTIINEGWKQGDFKMFKVLKDEGNPLLYDLEKDIKLDRVSRVVFPPYFDQWTYVPMFNARIKPCEVELAERKNTDPYVKRTLKPLKADCIELMRYHMSQYMDLRVSLQGTSLSIKQVPSSIHQSLAQDASYAGILSRRRENLDYKSQCPIVTNLFLLEKFFLLIFTTMEKHYWEMDDDETQYEHPKIDPSKFEVEGTLHDVSQVMVHLLDRFFEKRRFLRTVDESRWILHLIRSTSGSKRLEVLSRFFPAFSDGLRIREFKKVRDIMLLNFLPFLFLTGDNMAYEHRQWAVPVIFYADKIRIVPAEVGAYYNRFGLTCILELMMFFPSYDTRNEDLGEDVRACIGPIINYYLDTTISNGGIQTSIVSTKALLYETYLSSICGGFSEAILWYLPVTHPSKCLIALEVSDALTSPELRIDRIRRRFPLSSNHLKGIVQVSVRPDRTFSVITQGIVKHRVCKKTLLRHRCDVILIQTPGYVFGNDELLTKLLNI

SEQ ID NO: 36 - protein, 526 aa, artificial sequence
  VP5 of BTV13 AE53029
MGKIIKSLSRFGKKVGNALTSNTAKKIYNTIGKAAERFAESEIGSAAIDGLVQGSVHSIMTGESYGESVKQAVLLNVLGAGDEIPDPLSPGERGIQMKIKEIEEEQRNELVRIKYGKEIREKFGEQLEEIYQFMNGEVKGEEEQEEQYKVLCKAVDSYENLLVTENEQMRTLARALQREATERTENESKMVKEYRQKIDALKAAIEVERDGMQEEAIQEIAGMTADVLEAASEEVPLVGSGMATAIATGRAIEGAYKLKKVINALSGIDLSHLRTPKIEPTMVATTLEHRFKEIPDKELAVSVLAKNDAIVANTKEIKHIKEEILPKFKKIMEEEKELEGIDDKKIHPRVMMRFKVPRSQQPQIHIYSAPWDSDDVFFFHCVSHFHANESFFLGFDLGIDVVHFEDLAAHWHALGAAQEAKGRTLNEAYREFLNLSIGSTFTSPMHARRMIRSKTVHPIYLGSMHYDITYETLKTNAQKLVYDEDLQMHILRGPLHFQRRAILGALKFGVKVLGDKIDVPLFLKNA

SEQ ID NO: 37 - protein, 955 aa, artificial sequence
  VP2 of BTV14
MDELAIPIINGHFPKETLIEYDCIIELNPPVEDDAADVVQIPTRDMMDIPNVPIRDALKHLPQRNDGHVLTRVLDISLSGYDRRKYHKTNSGGEFYSPNEWLNWMINDSMDVQPLKVSLGLPPTIRHELFSSSVFISAKKADTTSYHIEPICEKDKACDHTRVSMWNNLTRHEMMHCAQESAYVLKPTYDITVYSERATTDEAFQQVGQKFVTITKNHRVVLGDDAYKKTLGGLTRLRVQGKIPSLIQNDIQQLNQIRDTWIRDSYNPRNIRSLELCKLLSGIGRKMVCIEEEPKNESDLSVKFQFKLDEKFRLDDSERGVIFTNKGQRNDQDRFYVLIMIAASDTYNSRIWWTNPYPCLRGALIAAETQLGDVYWTLRHFYEWSVRPAYSPRLREREDDKYIYGRVNLFDLDASPGTKIIHWTYDLITRESKITYHNGNPCDLNPDVDGIITKFNKTAYTDMIGELLNGGWNTREFKMYKILESVGNVLTIDFEKDAKLNSRSEFILPDYYDKWIYAPMFNAKLKITEVEIAQAKSDDPDVVRTLAPIGSDPITLQRLCLGNYYDIRPAMHGRALMKKQEQTSYHKTLAKTKDYSDVLNRRGYRKVEKPCPMVTCSYVLEKTALFWIDVMEKHVGDIEDSTDEFDFPRVDVTLPVETHKVVDVAQLSVLLIDFLYEKRRTVRDIDSARWTIELIRRVRGKDRLEAIRREFPNFGEAVTILMNPTRVKDVMVINFLPFLILLGDNISYEHRQWSIPIILHADSMWFLPVEVGAFYNRFGVISFLEYMMFFPSAQSRESELDEAKIKVSKLILEFYLDTTIFSGGVQRSVVSTKQILYETYLSSLCGGYSEGLVWYLPITHPTKCVVAIEFSDDRVDAAHRCNRLRARFPLSAVHLKGIVILSIAKDRAVKAYTEGIVTHRLCKKNVLGFTCQILLLKFSGHVFGNDEMLTKLLNV

SEQ ID NO: 38 - protein, 526 aa, artificial sequence
  VP5 of BTV14 CAE53030
MGKIIKSLSRFGKKVGNALTSNTAKKIYSTIGKAAERFAESEIGSAAIDGLVQGSVHSIMTGESYGESVKQAVLLNVLGAGDEIPDPLSPGERGIQMKIKELEEEQRNELVRLKHGKEITKKFGEELEEIYQFMNGEVKDEDEQKKQYEMLCKAVDSYEKLLVAENDEMRTLARALRRETTERTEVESKMVKEYRQKIDALKAAIEVQRDGMQEEGIQEIAGMTADVLEAASEEVPLVGSGMATAIATGRAIEGAYKLKKVINALSGIDLSHLRTPKIEPTMFATTLEHRFRDIPDKELAVSILAKNNAIVANTREVQHIKEEILPKFKKIMDEEKELEGIDDKRIHPRVMMRFKVPRSQQPQIHIYSAPWDSDDVFFFHCVSHFHMNESFFLGFDLGIDVVHFEDLAAHWHALGAAQEAKGRTLNEAYKEFLNLSIGSTYTSPMHARRMIRSKTVHPIYLGSMHYDITYETLKSNAQRIVYDDELQMHILRGPLHFQRRAILGALKFGVKVLGDKIDVPLFLKNA

SEQ ID NO: 39 - protein, 952 aa, artificial sequence
  VP2 of BTV15 CAE51102
MEDFPVSVIERNSTIAPAIIKRYPIIVDVRNMVALSGGKNDVTNIPRVRNIGVRQEGIRVGLKYRPDTETNVIFPKNLDVLIRAYDHKHRLTRDKRPTDHDVDSISDGDVTVWVTNRTNEFYDIQPIYHTLEDEVCKVKFTSLLGSVSTDSNYAESMSYHYIGVERDKCDHSKWHRFFPMLLSDSINLGKEVGYILKKTYKIKAIGEAREGQRQELRVDVPYTPGIGRNERISDMKLPVYKRFLEGYIRCQIEPNVPEKLTELKNQLDAICVAWYGGQVPIVADEICKITSRIGRLMWNTEEEPVDETMRSRAFQESIRLMFRTENSEYNNIQAIGSGRTQRQKFYAPLIIAATDSFRWRIWWNNPYPCLRGCLIACEMELGDVYKSLKSIYKWTLRSSYSSQREIDRQLNVFPYQKINLFDFSGTPGTEIIHWRIVHIPVPDEIDYEHGYLCPESGDYDIVMAVDDDLYSAFKHRVIDRGWEHQAMKLDELVPQENNIFKMEFEKDAYLDNRNHLVLPPYYNKVVYCPLFHATAKITPTEISHRQSDDPWCERTLYGFRGDHVITHYTGLNHIVNRRKPLMGQTLSVAQSMGDYTKYILGDDGSANSCTGTAYSSRLPTMLFQDIFDAIIRHLPKVILKDQADYFSESRKRVSDIIDWDTFIVYSIYACFERKNQVLREEDATQIVRGISTAGKEKRLKLIERSFPIYYRELMKIKNAKTWKDAYAFNFLPLLLCAGTNVQYVHRQWSYPVLVSMEKGPRIIPAMVGRDLADGNLGDWHAYIKYYMGQHMEDQEVEEDSLEILKISLEHYMSHSYISNVKDVAVRMTKEIVLDLYFASGCNGVSEMMTFLLPIIHPRKGLVMFCIADDQVQPQVQCETALRRFPYTREYIHDVIVIQVGRPGELKQVWKRGSTKVKVCRRNFLRYDHKVILSRLCGLVYGNYELMTKLTNI

SEQ ID NO: 40 - protein, 527 aa, artificial sequence
  VP5 of BTV15 CAE53032
MGKIIKSLGKFGKKISSALGSSTAKKIYSTIGKAAERFVESDLGSATIDGIIQGSVHSALTGESYGESVKQAVILNVVGGGDSIADPLSPGENDMVHRLKRLEDEQKGEIIRTKHNAQVIAKFGRDLEDVYKFASREHKVGEEEEDQIQMLEKALRAYGNVVKVEGESVQKLAKALRVDEEERTDEETRMIGEYRDKIDALSKAIEIEREGLQDEAIQEIAGMSAEVLEAAAEEVPIFGAGVATSIATARAIEGAYKLKAVITALTGIDLSHMTTPKIQPKTLEAILDAPGGNVTDLMLTRGLDSKIDKINENLAEVEHMQTSILPRIKKAIEEDRDEITNWSPKRIHPKSVQRFRVPRMQTPSIHIYAAPWDSDSVFIFHVISPHHLNESFFLGFDLEIEYVHYEDLAQHWHSLGAAQEVTGRTFREAYREFFNLASRSTMASDIHKKRLQRSRMSHPIYLGVHNYELSYIAIKSNAMQLVTDEDLQKHVLRGPLHFQRRVIMAALKYGVKVMSRADDIAMMLRDA

SEQ ID NO: 41 - protein, 959 aa, artificial sequence
  VP2 of BTV16 CAE51103
MEELVIPVITRQFDKKLVGRYDYVIELTEPEDGEWSGHDVTEIPNRRMFDIKQQNIREAIEYKPVDNDGEVLPRILDMSIACYDMKKSMMKKDGVDFVSNTRWLEWMIGDSMDVQPLRVQLKEDHSTIQYGMFSNTLHIDSRKADTTSYHTIAVESKGERGCCHVHTAIWNHMVRNHLFNAVQEACYVFKPTYDLIVIGEKQNREDEFRIGEHNFYTITRNHHMRLGDNAYNQFMKGLVQLRVAGVTPNAIREEMAALDAIRDTWIGGNFERTHIKSLEICKLLSSIGRKMVNMEEEPKDERDLSVKFQFKLDDKFSTTDPERNVIFTHKTHRTNQDRFYVSLMIAASDTNNGRVWWSNPYPCLRGALIASECKLGDVYHKLRAWYEWSVRPEYKPRDLEREQEKYIVGRVNLFDLEGEPATKVFHWEYELINKVYQITNHTGNHCDLYPDDVEITAKFDEEKYGEMIQMIINEGWKHGDFKMFKILKEEGNPLLYDLEKDIRLDSRSQVIFPPYFNKWTHAPMFNAKVKPCEVELAQRKNEDPYVKRTVKPIRADCIDLLRYHMSHYMDVRVSMKGLSLAVKQTPSSIHQEWAKDPLYPGFLQRRDENLDHKSVCPIVTNYFWLERFYTLVLTIMEKHYWDLDDSDVTYEFPTLDDSAYKIEGTLYDVSQVVVHMIDRFFEKRRFLRSVDECRWILHLIRSTRSRDRLSVFKRFFPTFGEGLCVNNFRKVKDIMLLNFLPFFFLIGDNMAYEHRQWAVPLLFYADKIRVIPAEVGAYYNRFGLVSILELLTFFPSYEMRDNKVEEDVHACASAILDFYLTTTISNGGIQASIVSTKALLYETYLSSVCGGFSEAILWYLPITHPVKCLVALEVSDSLVDSNVRIDKIKRRFPLSHRHLRGIVQISVRPDRTFGVTTCGIVKHKICKKTLLKQRCDVILIQIPGYVFGNDELLTKLLNI

SEQ ID NO: 42 - protein, 526 aa, artificial sequence
  VP5 of BTV16 CAE53035
MGKIIKSLSRFGKKVGNALTSNTAKKIYSTIGKAAERFAESEIGSAAIDGLVQGSVHSIMTGESYGESVKQAVLLNVLGAGDEIPDPLSPGERGIQMKIKEIEEEQRNELVRLKHGKEITKKFGEELEEIYQFMNGEVKDEEEQEEQYKVLCKAVNSYEKLLIAENDKMHILARALQREAAERTEAESTMVKEYRQKIDALKAAIEIERDGMQEEAIQEIAGMTADVLEAASEEVPLVGSGMATAIATGRAIEGAYKLKKVINALSGIDLSHLRTPKIEPTMVATTLEHRFEDIPDKKLAMSILAKNNAITANTREIQHIKEEILPKFKKVMDEEKELEGIDDKKIHPRVMMRFKVPRSQQPQIHIYSAPWDSDDVFFFHCISHFHANESFFLGFDLGIDVVHFEDLAAHWHALGAAQEAKGRTLNEAYREFLNLAIGSTYTSPMHARRMIRSKTVHPIYLGSMHYDITYDTLKSNAQRIVYDDELQMHILRGPLHFQRRAILGALKFGVKVLGDKIDVPLFLKNA

SEQ ID NO: 43 - protein, 955 aa, artificial sequence
  Vp2 of BTV17 CAE51104
MEEFVIPVYSEDEIPYALLSRYPLAIQTNVKIEDVEGKHNVVKIPESDMIDIPKLTIVEAMNYKPARNDGIVVPRLLDITLRAYDDRKSTKSARGIEFMTNARWMKWAIDDRMDIQPLKVTLDHYCSVNHQLFNCVVKANAANADTIYYDYFPLEDYKKRCNHTNLDLLRSLTNMELFHALQGAAYSIKSSYELVAYSERGSLEETYVVGQPKWIHLTRGTRIGNSGLSYERFISSMVQVSVNGKIPDEIANEIAQLNRIRAEWITATYDRGRIRALELCNILSTIGRKMLNTHEEPKDEMDLSTRFQFKLDEKFNRADSEHVNIFGVRGPATDEGRFYALIAIAATDTQKGRVWRTNPYPCLRGALVAAECELGDVYSTLRRVYRWSLRPEYGQHERQLENNKYVFNRINLFDSNLAVGDQIIHWRYEVKASAETTYDSGYMCRHEAEEDELLCKINEDKYKEMLDRMIQGGWDQERFKLHNILTDPNLLTIDFEKDAYLNSRSELVLPDYFDKWISSPMFNARLRITKGEIGTSKKDDPWNNRAVRGYIKSPAESLDFVLGPYYDLRLLFFGETLSLKQEQSAVFQYLSQLDDFPALTQLTGDAVCPHSGGALYTFRKVALFLIGNYEKLSPDLHEGMEHQRYVHPSTGGTYQKRVLEMKDPCQLTCFVIDYIFEKREQLRDTKEARYIVYLIQSLTGTQRLSVLRSTFPNFFQRLLMLKEIKFVRDLNVINFLPLMFLVHDNISYWHRQWSIPMVLFDDTIKLIPVEVGAYANRFGFKSFMNFTRFHPGELKKKQIAEDIHKEFGVVAFEYYTNTKISQGNVHTPVMTTKMDVLRVHLSSLCAGLADSVVYTLPVAHPKKCIVLIIVGDDKLEPHTRSEQIVSRYNYSRKHICGIVSVTIGQNSQLRVHTSGIVKHRVCDKFILKHKCKVILVRMPGYVFGNDELMTKLLNV

SEQ ID NO: 44 - protein, 526 aa, artificial sequence
  VP5 of BTV17 CAE53036
MGKIIKSLSRFGKKVGNALTSNTAKKIYSTIGKAAERFAESEIGAATIDGLVQGSVHSIITGESYGESVKQAVLLNVLGTGEELPDPLSPGERGIQTKIKELEDEQRNELVRLKYNKEITKEFGKELEEVYDFMNGEAKEEEVVQEQYSMLCKAVDSYEKILKAEDSKMAMLARALQREASERSQDEIKMVKEYRQKIDALKNAIEIERDGMQEEAIQEIAGMTADVLEAASEEVPLIGAGMATAVATGRAIEGAYKLKKVINALSGIDLSHMRSPKIEPTIIATTLEHRFKEIPDEQLAVSVLNKKTAVTDNCNEIAHIKQEILPKFKQIMDEEKEIEGIEDKVIHPRVMMRFKIPRTQQPQIHIYAAPWDSDDVFFFHCVSHHHRNESFFLGFDLGIDVVHFEDLTSHWHALGLAQEASGRTLTEAYREFLNLSISSTYSSAIHARRMIRSRAVHPIFLGSMHYDITYEALKNNAQRIVYDEELQMHILRGPLHFQRRAILGALKFGVKILGDKIDVPLFLRNA

SEQ ID NO: 45 - protein, 957 aa, artificial sequence
  VP2 of BTV18 CAE51105
MDELAIPIYTDTFPAGLLDGYDYIIDVSTRVDEPKGRHDVTEIPKRSMFDIKDEPIREAIIYKPVSNDGCVLPRVLDITLRAFDDRKRVITNEGHSEFHTRSNWLQWMIDDAMDYQPLKVDVEHVPSRISHALSNSTVRLHAKRADTASYHIEPVEVEAYGCNHVWTERIHHLVNIEMFHSSQEAAYILKPTYQIIAHAERAAVGDAFNGRTLELNRNHRIQLGDQGYVKLKKGWVQTRIEGKKPAAIEREIASLNEIRAQWIARGHDRREIKALDLCRILSAIGRKMYNIEEEPKNEADMSVKFQMELDEIFKPGNSEHDNIMGGGTHRKDEDRFYVLIVIAASDTNQGRVWWSNPYPCLRGALIAAEVQLGDVYSTLRSWYQWSIRPAYVPYDRSRENDKYIYTRTNLFDSALGPGDKIIHWEYQLLNETREVSMSSGNECDLFPEDEEFTTKFNEERYTEMKGQIIQSGWNHRDFKMHKILEDGANVLTIDFEKDARVGTGSVLTLPDYYDKWIVAPMFNAKLRITETVIANAHSDDPAIERSVKPFDHDPSTLQRFCLARYYDIRPGLRGRALLKQQDGSTITKKVSALDDYQDVVSRRVNYVQRDVRCPTETAQYVLEKTSLYLLALFDKHVMPSAESEAKFVHPSIDVKHDIETWRIADISQLIVLIFDYLFESRKVVRDAVEARWILYKIRSSTGRARMEVIETTFPRFGLTVKNITKAKVNQDIACLNFFPLFFIVGDNMAYAHRQWSIPILLYAHDIRIIPLEVGAYSNRFGLTSYLEYMIFFPSYATRMAMIDEANKECAAALLDYYLSTDVHRGGVMTSVITTKRLLYETYLSSLCGGYSDGLLWYIPITHPLKCLVAFEVADDVVPATVRKERILMRFPLSARHLRGIALITIDRDRKVHVQTEGIVSHRLCKKNLLKYVCDVILFKFSGYVFGNDEMLTKLLNV

SEQ ID NO: 46 - protein, 526 aa, artificial sequence; identical to SEQ ID NO: 12
  VP5 of BTV18 CAE53037

SEQ ID NO: 47 - protein, 962 aa, artificial sequence
  VP2 of BTV19 CAE51106
MDEFAVPIVRGRTIPYDLIRAYETIIDLDVKVEENEGKHDITKIPESYMCDVPDIPIQDATTATLSRNDGYALPRILDVSIAAYDTRKGYQKYNGIERMTNQVWLKWAIKDFMDVQPLKVSLTDAEGKVRYDLFNCSVRMDAKKAEAVYYGWAAQEVIDKGCNHARSELLQHVIRCELSNCAQESAYMLKPTQKLEPVAEKTSLSERLLPGSSHLTSMRRGEVFRMGTEQYNRMVQGMVSSQGVKGHTPGKTRIQDEMNELMKIRDRWKVARDRREIKSLELCKLLSSVGRKMYDKYEEPKDEEAMSLRFQWNLDEIFKTDNREHINIAVEKSGRTNDERFFALIMIAATDTNRGRIWWSNMFPCLRGALIVGETQSGDVYKMLRVRFDWSVRNEYSTQADVARQNDNYTFTRVNLFDLISEPATPVIHWEYDLDAPRKTNYLDGHACDEFPDDYDLVCSFDETKYSEMIQRILDGGWDHKNFKYYKILKDAGNVLTIDFEKDARLNEHSEMVMPSYFNKRIAAPMFRCILRICETTISVRQNADPAVSRTIRPLKAKAADLLDFTLGSYYDTRFGVMGRTLVMSQKQSEMYKMIQEAEDYSELMKSRGVIEKFKNPCPITTACQYTLQKTSVLILSRAQRYFREFHGGDQEEYMSPTLNFEWSDMTSNIYDVAQMVVLVFDVLFERRRVVRGVDESRFILHQLRIRKGLNRLDYVKIHFPHLYQWWKASESTYGEAQKLNLLPLLFLVGDNFIYEHRQWAYPAVLISHKLRFIPVELGAYYNRFGLTSLISHLTFHVGKAKYDQNLDQAEQKVFSALKDYYAESTITDGGVNTHSTMTKDPIYQVYLSTICGGLLDSLVYLMPITHPIKSIVAIVINDGKGSASDCVRRVTRKLRYIQHHIRGSVVISILSDGSINTYSEGIAKATLCDKSVLKYSYKVVLIKVKGHVFGHDEMLTKLLNV

SEQ ID NO: 48 - protein, 526 aa, artificial sequence
  VP5 of BTV19 CAE53038
MGKIIKSLSRFGKKVGNVLTSNTAKKIYSTIGRAAERFAESEVGAATIDGFVQGSVHSIMTGESYGESVKQAVLLNVLGSGEELPDPLSPGERGIQTKLKELEDEQRNELVRLKLNKKIVDKFGTELEEVYDFMNGAAKDDENEIKQYDILCKAVDSYGKILREEDKKMLELARALQRESESRSDEETKMVREYRSKIDALRDAVDVERESMTEEAIQEIAGMTSDVLEAAAEEVPLVGSGMATAIATGRAIEGAYKLKKVINALSGIDLTHLRTPKIEPSLIATTLEYRDRPIPDDSLAVSVLEKRRAIEENKNEIEHIKNEILPRFKKAMEEEKEISGIEESVIHPKVMMRFKIPRSQQPQIHIYCSPWDSDTVFFFHCVSHHHMNESFFIGFDLELDLVHFEDLTAHWHALGAAQTVVGRTFQEAYREFLGRAMMDPSSGAMHKRRMSRSRSVHPIYLGSMHYDISYATLKSNAQRIVYDDELQMHVLRGPIHFQRRAILGALKHGIKILNDKIDLTSLLRNA

SEQ ID NO: 49 - protein, 956 aa, artificial sequence
  VP2 of BTV20 CAE51107
MEEFVIPVFSEQDMPYALINQYPLAIRTDVKIPDVEGIHDLAKIPESDMIDVPKLDIVSALNYKPVRNDGIVVPRLLDITLKAYDDRKSTKDAQGIKFMTNAGWMKWAIDDRMDIQPLKVKLDQHYSIDYQLFNCVVKAKTANADTMYYDYFPIENKTKKCNHTNLDLLRSLTAVEMFHVLQGAAYNLKANYELIANSERESLEESYPIGSQKWVHLTRGTKIGNSGVPYERFISSMVQVVVKGKVPVEIVSEVVRLNEIRTEWINAGFDRSRIRALELCNILSTIGRKMMDTQEEPKDEMDLSTRFQFKLDDKFNTADSEYIVISRVGGAATNEGRFYALIAIAATDTQRGRVWRTNPYPCLRGALIAAECELGDVYYSLRHTYQWSLRPEYDQRERSLENNKYVFSRINLFDSNLTVGDKVIHWRYDLTKPMDTTFDDGYMCVSHEIDGELLCRIDDDRYKEMLERMIQGGWDQERFKLHSILTEPNLLTIDFEKDAYLNSRSELVMPDYFDKWINSPMFNARLRLTHGEIASRKTDDPWNNRVVFGYIKTTTESLDYMLGRYYDVRLQFYGDTLSQGQRQSSVFAYISQRDDFQTLTHYVKDDAICPHAGGSIYTFRKTALMLMANYEKLSPELHEGLEHQTYTHPSDGMDYRKYVVDMKDLSQLICFVFDYIFEKRAQLRDPKEARRILYLVQNNVGSQRLGVLSSAFPNLANRLLKLREIHFIYDMNVINFLPLLFLVQDNISYWHRQWAIPMVLFDETIKLIPVEVGAYANRFGFKSFFNFTRFHPGDSRKKQIADDVHKEFGTICYEYYMNTRMSQGGVNISVVTTKLDVLKIHLASLCAGLADSIVYTLPVAHPRKCIVLIVVGDDKLEPQIRAEQVLSKYYYSRKHVLGVISISVSQDGKLKVYSSGIVRHRLCEKSILKYKCKTILIRMPGHVFGNDELMTKLLNI

SEQ ID NO: 50 - protein, 526 aa, artificial sequence
  VP5 of BTV20 CAE53039
MGKIIKSLSRFGKKVGNALTSNTAKKIYSTIGKAAERFAESEIGAAAIDGLVQGSVHSIITGESYGESVKQAVLLNVLSAGEELPDPLSPGERGMQAKIKELEDEQRNELIRLKYNKEITDAFGKELNEVYEFMNGETKEEEVVQEQYSMLCKAVDSYEKILKAEDSKMAVLARALQREASERSEDEIKMVKEYRHKIDALKNAIEVERDGMQEEAIQEIAGMTADVLEAASEEVPLVGAGMATAVATGRAIEGAYKLKKVINALSGIDLSHMRTPKIEPTIIATTLEHRFKDIPDDRLAISVLNKKAAVADNCNEISHIKQEILPKFRKIMDEEKEIEGIEDKVIHPRVMMRFKIPRTQQPQIHIYAAPWDSDEVFFFHCVSHHHRNESFFLGFDLGIDVVHFEDLTSHWHALGNAQEATGRTLTEAYREFLNLSATSMFSSVIHTRRMIRSRAVHPIFLGSMHYDVTYEVLKNNAQRIVYDDELQMHILRGPLHFQRRAILGALKFGVKILGDKLDVPLFLRNA

SEQ ID NO: 51 - protein, 955 aa, artificial sequence
  VP2 of BTV21 CAE51108
MDELAIPIIDGRFPKEALLEYCCIVELNPASEEDDVDVTTIPQKDMVDIPDAPIREALNYLPKRNNGHVLTRVVDISLSGYDRRKYHRTSTGGDFLSPEEWLNWMIRDSVDVQPLKASLEFPSKIKHSLFSSNVYVSVKKADTISYHIEAKEVETRACDHARVAMWNNLVRHEMMHSAQEPAYILKPTLDIIVHSERASTDVPFELVGQRYISIGKNHRIVLGDDAYRKTLDGLTRLRVQGRIPELIRNEIQQLHQIRDAWITDSYNPRHIRSLELCRILSHIGRKMVHIEEEPKDESDLSVKFQFKLDEKFRINDDERNVIFTSKGQRNDQQRFFVLIMIAASDTYNSRIWWTNPYPCLRGALIASETSLGDVYWTLRHFYDWSVRPVYSPRQKEREDDKYLYGRVNLFDLDADPGTQIIHWEYKPITSTVKTTYERGNMCDLFPDVDGITTKFNKTAYIDMISELLNGGWNTREFKMYKILESVGNVLTIDFEKDTKLNSRSELSLPYYYDKWIYAPMFNARLKITQTEIAQRKADDPSIYRTLAPISSDPIDLQRMCLANYYDVRPAMHGRALSKRQEQSAYHKNLANLADYQDILKRRGYRKVENPCPLITCSYILEKSALLWIDIMEKHVGYAPESEIEFDFPKVNTSTRIGTERIVDISQLVVLMIDWLYEKRQTTRSVDEARWTVQVIRRVTGKKRLEAISREFPNFGEAVSRLACPKTVRDVMVINFLPFLFLLGDNMAYEHRQWSVPIILYADTLWFLPVEVGAYYNRFGIVSFLEYLTFFPSNHMRTVALDEAESKVGKLILEFYLNTTIYLGNIQQSVISTKQILYETYLSSLCGGFTEGLVWYLPITHPQKCVVAIEICDDRVSAGYRCDKLRSRFPLSLDHLRGIVILSVSKSRAISAYSEGIVSHRLCKKNVLGFTCRVLLLKFSGHVFGNDEMLTKLLNV

SEQ ID NO: 52 - protein, 526 aa, artificial sequence
  Vp5 of BTV21 CAE53040
MGKIIKSLSRFGKKVGNALTSNTAKKIYSTIGKAAERFAESEIGSAAIDGIVQGSVHSIMTGESYGESVKQAVLLNVLGAGDEIPDPLSPGERGIQMKIKEIEEEQRNELVRLKYGKEITKKFGEELEEIYQFMNGEVKDEEEQEEQYKVLCKAVNSYEKLLIAENDKMRILARALQREAAERTEAESTMVKEYRQKIDALKAAIEIERDGMQEEAIQEIAGMTADVLEAASEEVPLVGSGMATAIATGRAIEGAYKLKKVINALSGIDLSHLRTPKIEPTMVATTLEHRFEDIPDKKLAMSILAKNNAITANTREIQHIKEEILPKFKKVMDEEKELEGIDDKKIHPRVMMRFKVPRSQQPQIHIYSAPWDSDDVFFFHCVSHFHANESFFLGFDLGIDVVHFEDLAAHWHALGAAQEAKGRTLNEAYREFLNLAIGSTYTSPMHARRMIRSKTVYPIYLGSMHYDITYDTLKSNAQRIVYDDELQMHILRGPLHFQRRAILGALKFGVKVLGDKIDVPLFLKNA

SEQ ID NO: 53 - protein, 951 aa, artificial sequence
  VP2 of BTV22 CAE51109
MEDFPICAIERESVYDEDFIMRYPVIVDLKECVADRRNKTDVSKLEEIKGVCVRSEGVRVALTSRPDPLSHVITPSALNVLIQAYDRKHKVSLRKRFEDGEGVTEYDLDTWVKKRLEEQADLQAVYHTIDANRGKLKFKTLMGTIRLDSNYAETVGYDYAPVSKAGCNHGNEDPLYDFILSGAFQVSKTAGYTLKQTYRLTVRTEVRENNKNELVVNEIYTPGIVRGEQIRDMTSVAYMRFRDGWIRAIIQPQIVEELRASKDALDRISNEWYSSRNTPDVVEICRIVSSIGRRMWNSEETPVDDAMRSRVFQEKLRLLFRVGNSEYDTIQSISSGQTDLKKFYALLAIAATDSYRWRIWWSNPYPCLRGTIIACEMELGDVYKTLRSTFRWSLRPEYANRSEIDREKKAYPYQRINLFESKLTPGTRIINWLVTRVPLEKPDISTGRVCMTSTESNYILKIDDARYKQMISQIIERGWEKEQLKFEKIVQDDGNVFKMEFEKDACMDEKSHLVMPYYYDKEIHCPIYHQKIKITEAQMANEWSDDPWVNRVVSGYLGDHVETYGLGYNHIFDTRVPLKGNLLEQEQEISSYHEHLRSDESKEDDTHCALRIFSDKAIRMLFIAIYKKLIHHIPKEEYATREEELIQYISMVERVRSWDQFIVFIFDFFFENRKGIRTMEEATQLAKSIRGSVGAMRWTIFSSSFPTSYRLMKQILVAKRWGDCYIMNFLPLLICGGTSISYLHREWSYPMIVTFEDGIKIVPTMVGRSLPQGSLGEWVSFISFFMGTVHEKIKVEEDELEVLRRCVEFYRDVKMVDVIKDTPVRMTKYITCDLAFGSGCGGISESISFILPVTHPNRSLVVFVISDDKLSPSQHAARAKRRFKGTCQYIDDVIVLQMKRPGLVGSVWSEKHSKIKVCRRNFLNYDHKVILTKFAGLVYGNYELLTKLANL

SEQ ID NO: 54 - protein, 529 aa, artificial sequence
  VP5 of BTV22 CAE53041
MMGKIIKSLGKFGKKVGNALTSKTAQKIYKTIGNAAERFAESEIGSAAIDGLIQGSVHSIMTGESYGESVKQAVILNVLGGGDTIADPLSPGENEIYRKLRQLEEEQKGEVVRTKHNTEILDKFGRDLDEVYKFATQEHKVGEDEEDQIKMLEKALKSYVGVFKAENESINKLKQALYLESTERTDEETKMISEYRDKIDALRGAIEVEKEGLQEEAIQEIAGMSADVLEAAAEEVPLFGAGVATSIATARAIEGAYKIKAVISALSGIDLTHLSVPKVQPKTLEAILDTPKGKDISDLRLTEGLIAKMDKISENISEVDHIQNVIVPKLKKAAEEDKENITNWSEKRIHPKTVQRFKIPQAQRPSMHIYAAPWDSDEVFIFHIISPHHKNESFFLGFDLEIEYVFYEDLTQHWHALGAAQSAYGRTFREAYREFFMLASNVAGQGAIHQKRLLRSRSSHPIYLGMHDYEVSYEQIKMNAMALVSNEDLQMHVLRGPVHFQRRTIVAALKYGIKILTQPDDVSVMLRNA

SEQ ID NO: 55 - protein, 957 aa, artificial sequence
  VP2 of BTV23 CAE51110
MDELAIPIYTNVFPAELLDGYDYIIDVSTRIDEPAGRHDVTQIPNSAMFDVQNEHIRDAIISKPVSNDGYVLPRILDISLRAFDDRKRIITSGGQSEYHTKADWLQWMIDDAMDVQPLKVDTAHTRTRVSHALFNCTVRLHAKKADTASYHVESIEIEPNGCNHAWIQRVHHLVNIEMLHCSQEVAYMLKPTYETIVHAERASTSDTFNGRTIELSRGHRVQLGDAAYEKLKNGLVQTRIEGKKPQLVEGEINSLNDIRQRWINSGHDRREIKALELCKILSTIGRKMLNTEEEPKNEADLSVKFQMELDEIFRPGNNERTNIFGGGNHRKDEDRFYVLIMIAASDTYKGRIWWSNPYPCLRGSLIAAEAQLGDVYNTMRNWYQWSVRPTYTPYDRSRESDKYVYSRVNLFDSTLRPGDKIIHWEYKLLNEVREVCIKDGNECDLFPEDEEMTTKFNEEKYTEMKGQIIQDGWNHRDFKMHKILQDGANVLTIDFEKDARIGNGSVLTLPEYYNKWIVAPMFNAKLRISETVIAKAHSDDPAVARTAKSFDHDPFNLQRYCLARYYDVRPGLMGRALSKEQEGSAIANKVAALEDYRDVISRRLGYVEREKRCLTETAQYILEKTSLYLLNVLSMHVKPTIDMDIKFKHPSIDTHLDIDTWKIADISQLIVLLFDYLFESRKEIRSVTEARWILFKVRSVSGQERLNMIQSFFPRFGRVVRDIAKAKITQDVAHLNFFPLFFIIGDNMAYAHRQWSIPVLLYAHDIRIIPLEIGAYNNRFGFTSYLEYMTFFPSHATREAVLDESIKECSLALTNFYLNTDIHSGEIMRNVVTTKRLLYETHLASLCGGYSDGLLWYVPITHPSKCLVAFEVADDVVPYSVRRERIISRFPLSSKHLRGIALIAVNRNQKVSVQTEGIVTHRLCKKNLLKYVCDVVLFKFSGYVFGNDEMLTKLLNV

SEQ ID NO: 56 - protein, 526 aa, artificial sequence
  VP5 of BTV23 CAE53043
MGKVIRSLSRFGKKVGNALTSNTAKKIYSTIGKAAERFAESEIGSAAIDGLVQGSVHSIITGESYGESVKQAVLLNVLGSGEEIPDPLSPGERGIQAKLKELEDEQRNELVRLKYNDEIKKKFGEELEQVYDFMSGAAKEEAGDEKQFDILNKAVNSYNKILAEEDLQMRRLATALQKEVGERTRVETTMVKEYRDKIDALRSAIEVERDGMQEEAIQEIAGMTADVLEAASEEVPLIGAGMATAVATGRAIEGAYKLKKVINALSGIDLTHLRTPKIEPTVVSTILEHRTRDIPDNALAVSVLSKNRVIQENHKELMHIKEEILPRFKKAMDEEKEICGIEDKVIHPKVMMKFKIPRAQQPHIHIYSAPWDSDDVFFFHCVSHHHMNESFFLGFDLSIDLVHYEDLTAHWHALGAAQMAVGRTLTEAYKEFLNLAISNAYGTQMHTRRLIRSKTVHPIYLGSLHYDVSFADLRGNAQRIVYDDELQMHILRGPLHFQRRAILGALKFGCKILGDRLDVPLFLRNA

SEQ ID NO: 57 - protein, 955 aa, artificial sequence
  VP2 of BTV24 CAE51111
MEEFVIPVYSENEIPYTLLNRYLLAIRTDVKINDVEKKHNVIKIPDSDMIDIPKISIVDALSYRPTRNDGIVVPRLLDITLRAYDDRKATKNAKGVEFMTNAKWMKWAIDDRMDIQPLKVTLDDHYSVNHQLFNCVVKAKPANADTVYYDYYPLESKMKKCNHTNLDMLRSLTTMEMYHILQGAAYGLKSTYELKAHAERENTGESYPIGERLLQIPRGTKIGSRGEPYNKFVAGLVKVTIKGKVPAEIGEEMNQLNRIKEEWKSASHDRSRIRALELCKILSTIGRKMLDAKEEPKDEMDLSTRFQFKLDEKFTKTDSEHINIFRAGGPATDDGRFYALIAIAATDTQKGRVWRMNPYPCLRGAIIAAECELGDVYFTLRQVYSWSLRPEYGQKEKPLEVNKYVFNRINLFDSDLTVGDQIVHWRYELYPPVETTYDDGYLCGSDKEDDELLCEVDEEKYKKMFENMIEGGWDQERFKLHSILTDPNLLTIDFEKDAYLNSRSELVFPEYFDKWINSPMFNAKLRLAHGEIATRRANDPWNNRAVHGYIRTSTESLGYALGSYYDLRLQLFGDALSLEQRQSAVFEHLNKQDDFFTLTGYAKDQVVCPHSGGAFYTFRRVALEILSNYEKLTPDLHEGLEHQTYTHPKINEYFNRFVLDMKDFSQLICFVFDHFFERHEQLRDVAEARRLVYLIQKSDGPERLDVLQRNFPNFFRRFMNLKDVKYIYDLNVVNFLPLLFLIQDNISYWHRQWSVPVILYGDIIRLIPVEVGAYANRFGMKSFFNFTRFHPGDSKKKQNADDTHKEFGLICFEYYTKTKISQGGVDISVVTTKMDTLKVHLASLCSGIADSIVYTLPVAHPKKCVVLIVIGDDNVDMQIRSEQAISRYYYSRRHIAGVVSICISQDGGLKAYSTGIVKHRICEKSILKYKCKVVLVRMPGYVFGNDELMTKLLNV

SEQ ID NO: 58 - protein, 526 aa, artificial sequence
  VP5 of BTV24 CAE53046
MGKIIKSLSRFGKKVGNALSSNTAKKIYSTIGKAAERFAESEIGAATIDGLVQGSVHSIITGESYGESVKQAVLLNVLGTGEELPDPLSPGERGMQTKIKELEDEQRNELVRLKYNKEITKEFGKELEEVYDFMNGEAKEEEVVQEQYSMLCKAVDSYEKILKAEDSKMAILARALQREASERSQDEIKMVKEYRQKIDALKNAIEIERDGMQEEAIQEIAGMTADVLEAASEEVPLIGAGMATAVATGRAIEGAYKLKKVINALSGIDLSHMRSPKIEPTIIATTLEHRFKEIPDEQLAVSVLNKKTAVTDNCNEIAHIKQEILPKFKQIMDEEREIEGIEDKVIHPRVMMRFKIPRTQQPQIHIYAAPWDSDDVFFFHCVSHHHRNESFFLGFDLGIDVVHFEDLTSHWHALGLAQEASGRTLTEAYREFLNLSISNTYSSAIHARRMIRSRAVHPIFLGSMHYDITYEALKNNAQRIVYDEELQMHILRGPLHFQRRAILGALKFGVKILGDKIDVPLFLRNA

SEQ ID NO: 59 - protein, 959 aa, artificial sequence
  VP2 of BTV25 ACJ06702
MDELVIPIFSADEMPYALISHYPLAIQTNRKIQNDREFHDLTKIPQSNMIDISQHGVIRALDYRPSRNDGIVIPRLLDITLHAYDKRRSMKDICGLEFKTDVKWMQWAINDRMDIQPLKVEIDNEHTVNHQLFNCNIKIRSKNVDTVYYDYHPLESEATKCNHANIELMRSLTMVELYHVLQGAAYALKTNFELIATAERGDVRQRYDAAGVRWSRLSRDQRIGYSGNAYDMFMANLVQVEVKGKCADEIAGEMGRLAKIKDKWVSNGFSGTVIFVSELCTEFSAIGRKMMDTHEEPKDEEGISRRFQIELDGMFSAARQENKNVLSQRGSKVTDESKFYALIMIAASDTQQGRVWRTNLYPCLRGALVAAECVMGDVYHTLRTVFNWSVRGTYGGTERNLENNRYIFSRINLFETNLPSGSKIVHWCYEEVAPIETTYDNGYICKSQEGVQNDEKLCKIDDDLYARMRDEAITGGWRQEDFKLHKILTNPNLLTIDFEKEAYITSTSDLILPDYFDKWIKAPIFNARLRITNGVIESEKKSDPWNKRVANGTMKTSAESLGYVLGRFYDLRMQFVEDVLNTRQQKSLALQHIRNLEDFTRLTDYGEEQNICPHAGGAMYTFRRVALEIITNYERLNPMDHEGNEYQTYRHPAIDYSKLGDVLKMKDLSQLICFVFDSIFERRDQLREVGEARMIIYQIQNATGERRLDVLKREFPTFYVWFHRLRDVELIRDLNVINFLPLLFLVRDNAAYRHRQWSIPMILYDEEIKLIPVEVGAYANRFGFKSFINFTRFHPGDARKRQEVSAFHKAYGSICYRYYTDTTISQGEVNVPVITTKLDTLRVHLAALCGGLSDSLVYTLPITHPEKCLVLVIVGDNKLNPQIRSELVISRYRYSRRHIRGVVSVCIDQEGLPNVYSTGIARHKIYEKTVLRYRCKIILVKISGYVFGNDELMTKLLNV

SEQ ID NO: 60 - protein, 526 aa, artificial sequence
  VP5 of BTV25 ACJ06704
MGKIIRSLSRFGKKVGSALTSNTAKKIYATIGRAAERLAESEIGSATIDGLLQGSVHSLVTGESYGESVKQAVLLNVLGTGEELPDPLSPGERGLQVKLKELEDEQRNDLVRLRYGEQIRAKFGAELDEIYQFMTSAIRNDGEAKEEYEILNKAINSYEKILKAEETQISTLARALQREASERSENEITMVKEYRQKIDALRDAIEVERDGMQEEAIQEIAGMTADVLEATSEEVPLVGAGVAATIATGRAIEGAYKLKKVISALSGIDLSHMRTPRVEPTTLATTLDRRFGEISDKDLAIGVLNKRTSVLDNYSEIAHIKQEIMPRFKRILDEERKIEGANKKYIHPRVMMKFKIPRTQQPHIHIYSAPWDSDDVFFFHCVSHHHRNESFFLGFDLGIDVVHFEDLASHWHALGSAQEASGRTLTEAYKEFLNLSISSAFSSPIHAKRMIRSRTVHPIYLGSMHYDVTYEVLKNNAQRIVYDDELQMHILRGPLHFQRRAILGALKFGVKILGEKIDISLFLRNA

SEQ ID NO: 61 - protein, 957 aa, artificial sequence
  VP2 of BTV26
MEEFVIPIYSSRDMPLALISQYPLAVQVDAIMADIGDDHNLALIPELNMIDISKQGIIDALDYRPARNDGVVVPRLLDITLHAYDCKRSMRTARNTEFATDTEWMKWAIEDRMDVQPLKILIDDHYFINHQLFNCNVKAKFGNVDTIYYDLHPLEKKEKKCNHMNIELMRSLTMTEMFHVLQGAAYTLKTNYTLTATAERQDISHSFENVGLRWQNLAPNTRIENRGSAYDKFIAGLVQVRIDGKCPNEITAELNQLRSVKEKWVGAQYQGNAIYAHEICSVMSAIGRKMLNAREEPVDEEGISRRFQQEIDDVFSQMNRENVAVRRVAVHANDEQKFFALMVIAATDVNQGRIWRTNPYPCLRGTLIAAECALGDVYSAMRRIFSWSVRPTYGTGEKQLENNRYVYSRINLFESNISVDEEVIHWRYELLAPAETTYDRGYICSVERGDDDLLCKIDDAAYKLMFDEAVRVGWQQHTFKLYKMLTEPNLLTIDFEKDAYLGPDSSLVMPDYYNKWIRSPMFNARLRLTKARINAEKTGDPWNDRVVGGTIKTPVESLGYTLGRFYDLRLQFVEDVLSYRQQQSAIFQYMGAREDFAMLTHYARGERDICPHAGGTLYITRRVALEVLTSYERLDPQYHHGREHLTYCHPSIDYTRRERIFEIEDLAQLICYVIDYIFEKRDSLREVGEARRIVYLIQSVTGIRRHEVLNQAFPRFFAWFLRLKNVEVIRDLNIVNFLPLLFLVRDNISYQHRQWSVPMILYDQTIKLIPVEVGAYANRVGFKSFFNFVQFHPGDAQKRQEADESHKKMGQICYAYYTDTTISQGKVDTPVIATKMDTLRVHLAAVCAGLSDSLVYALPVAHPERCIVLIIIGDEKLDPNVRTELVVSRYRYSRKHIRGAVSICMYKNGQFRVHTTGIVRHRICEKTILNFRCRAILVRTPGYVFGNDELMTKLLNV

SEQ ID NO: 62 - protein, 523 aa, artificial sequence
  VP5 of BTV26 AER60536
MGKIIKSLSRFGKKIGSALTSNAAKKIYATVGKAAERLATSELGTAAIDGLLQGSVHSMITGESYGESVKQAVLLNVLGTGEELPDPLSPGERGMQMKIQELEDEQRSELIRLKYDDEITRAFGNELREVYQFMNGQVRADLDQYDVLRKAVDSYEKLLDAEDAKMAILARALQKEMRERSAEEAKMVREYRSKIDALKEAIEVERDGMQEEAIQEIAGMTADVLEATAEEVPLIGAGAAAAIASGRAIEGAYKLKKVINALSGIDLSHMRTPKIEPTVISTVLEHRFKSIPDNLLANGVLSKKISIMDNQNEIRHIKREILPRFKRIMDEERAAANREHKVIHPTVMMKFKVPRAQQPQIHIYAAPWDSDEVFFFHCVSHHHRNESFFLGFDLGIDIVHFEDLTNHWHALGVAQEAKGRTLGEAYKEFLNLPISSSFSSRIHARRMVRSRLVHPIFLGSMHYDVTYETLKNNAQRIVYDEELQMHILRGPLHFQRRAILGALKFGVKILGDKIDIPLFLRNA

SEQ ID NO: 63 - DNA, 3944 bp, artificial sequence
  VP1 DNA of BTV1
gttaaaatgcaatggtcgcaatcaccgtgcaaggtgcacagctcatcaagcgagtggtcgaacgcttttatccagggatagcatttaatatagatgaaggagcatgttatatatataagttttctgatcatatacgacgcataaggatgaaacatggaacgaaatatcgacggcaggcggaagagattatgcgcaatataagcttgaggaaagagcgattgtatgggataccagtattagatgaggttgagtggaagtatgtgtttgatggtcaaacgttccaaagttacgcttttgaggtgtacgtgaactcaattttgccgtggagtgaacttgatccggaggaagagttcttacgtaattatagagtttcaagggagatgactgaagtggaaaaatttatcgaattccgtgctaaaaacgagatgcaaatatacggagatatacccattaaggtatggtgttgtttcatcaatgaactgagtgcggaattaaaacatattcccttagggatgcaagttatggctgactttgtaaaccgtttcgattcaccattccatcaggggaatagagatttatcaaatcttgaagattttcaagttgcatacactacgccgcttttgtttgaaatgtgttgcatggaatcaattttagaattcaatatcaaaatgcgtatgcgtgaagaagatatctcggcgctggaattcggtgatatgaaagttgatccggttggactattgcgtgagtttttcattctgtgcttaccacacccaaagaagattaacaacgttctaagagcaccatactcttggtttgtaaagatgtggggcgtcggagctgatccgatcgttgttttacaatctacggcaggcgatgacaggaattcaaaggatgtgttttatgacaagtttcgaaccgagccaaatcgatacaaagccctatttcggtcatcgttttataacgaatcaagacgaatgaatgaggagaagattctagaggcagtgaagtattcgcaaaaattgggctcgcacgaacgtagattacctctttttgagaaaatgttaaagacggtttatactacaccattttatccacataagagctcgaatatgatactagcgtcctttctattaagtattcaaactattactggatatggcagggcgtgggtgaagaacgtgagtactgagttcgataaacagctgaagccgaacccgagcaatctagttcaggatgtttcggatttaacgcgggaattctttaaacaagcatatgttgaagcaaaagaacgtagagaagagatcgttaaacctgaggatttatatacatcgatgttgcgattagcgagaaatacaagttcaggtttttcaaccgagatttatgtaaaaaagagatttggtccaagactaagggataaagatttgatcaagatcaattcaaggattaaggctttagttattttcactaaaggacatactgttttcactgatgaagaacttcataaaaaatataatagtgtagaactataccaaactaagggttcaagagatgtaccgattaaggctacgagaacgatatattcaatcaatctttcagtgttggtaccgcagttaattgttactttacccttgaatgaatatttttctagggttggcgggataaccagtccggattataagaagatcggaggaaaagtaattgtcggagatttggaggccacggggtcgcgcgtgatggatgctgctgattgctttcgtaactctgcagaccgcgatatattcacaattgcaatcgactatagtgaatatgatacacacctaacgcgacataattttcgaaccggtatgctccaaggaatcagagaagccatggccccctatagggatttgcgatatgaaggttatacgttggagcaaatcatagattttggatatggagaggggagagtagcgaatacgttgtggaatggaaagcgaagactgtttaaaactacatttgatgcgtatatacgattagacgagagcgagcgagacaaaggtagtttcaaagtccccaaaggagtgcttccagtatcgagtattgatgtcgcgaaccgaatcgcggttgacaaaggattcgatacgcttatcgcggcaacggatggaagcgatttggctttgatcgacacgcacctttccggcgagaattcgactctcatcgctaactcgatgcacaacatggctattgggaccttgatacaacgagaagttgggaaggagcagccagggattcttactttcttatcggagcaatacgtgggagatgacacactgttttacacaaagctacacactacagatactaaggtttttgataaagtggcggcttcaatttttaatacagtggcgaagtgtggacatgaagcttcacctagtaagacaatgatgacgccatattctgtggagaagacccaaacgcatgcaaagcagggctgttacgtaccgcaagatcgtatgatgattatctcatcagaaaggaggaaggatatcgaggatgtgcaggggtacgtgcgttcgcaagtgcaaacgatgataacgaaggtgagcagaggattttgtcatgatttggcgcagctaatattaatgcttaagactactttcatcggtgcgtggaaaatgaagcgaactattaaggaagatgcgatgtatcgcgacagaaagtttgattcgaacgatgaggatgggtttacgttgatacagattcgaaatcccttagcattatatgtccctataggctggaatgggtacggcgcgcatccggcagctcttaatatcgttatgacggaagagatgtatgttgattcgatcatgatctcaaaactggatgaaatcatggcgccgataaggaggattgtgcatgacattccaccgtgttggaatgagactcagggagacaagcgcggattgattagtgcaactaaaatgagtttcttttcgaagatggctaggcctgctgtccaagccgctttaagcgatccgcagataatgaatctagttgaagagcttccacttggggagttttcacctggacgtatctcgagaaccatgatgcatagtgctcttctgaaggaatcgagcgctaggacgttgttatccagtggttacgaactagaatatcagaaggctttgaatagttggatcgcacaagtttcgatgcgtttgggagaggagtcaggagtaatatcaacatcttatgcgaaactctttgacgtatacttcgaaggtgagttagacggcgcaccctatatgtttccagaccagaacttatctccgcagttctatatacagaagatgatgattggcccacgagttagttcacgagtgcggaattcttatgtagatcggattgatgtgatattgaggaaggatgtcgttatgcgcggctttatcactgccaataccattctgaacgtaattgagaaactgggaactaatcactcagtgggagatttagtcacagtttttacgcttatgaacatcgagacacgtgtggccgaagagctagctgaatatatgacttcagaaaagatacgatttgacgcgttgaagcttctaaagaaaggaatcgctggcgacgaatttactatgtcgttgaacgttgctacacaggattttattgacacttacctcgcctatccctatcagttgacgaaaacggaagtcgacgccatatcgttgtattgcacgcagatggttatgctacgcgcggcgctcgggttaccaaagaagaagatgaagatcgttgtaactgatgatgcaaagaaaagatacaagatacgtttgcagaggtttagaacgcacgtacctaaaattaaagttcttaagaagttgattgatccaaatagaatgacagttagaaatcttgaaaaccaattcgtttgagagcacgcgccgcattacacttac

SEQ ID NO: 64 - DNA, 2940 bp, artificial sequence
  VP2 DNA of BTV1
gttaaaatagtagcgcgatggatgaactaggcatcccagtttataagagaggatttcccgaacacctgcttcgtggttacgagttcataatagatgttggaaccaagatagaaagtgttggaggacgtcatgatgtaacgaaaataccagaaatgaatgcatatgacatcaagcaggagagcatccgaaccgcattatggtataatccgataagaaatgatggttttgtattgccgcgagtgctggatatcacattgaggggttacgatgaaagacgggcggttgttgaaagtacgagacacaagagtttccatacgaatgaccagtgggtgcagtggatgatgaaagattcgatggacgctcagcctttaaaggttgggttagatgatcaaagtaggaatgtagctcactcgttacataactgcgtagtcaaaatcgattcaaagaaggctgatactatgtcttaccatgtagagccgatagaggacgcgtcaaagggatgtttgcatacgagaaccatgatgtggaaccacctggtacgaatagaaacatttcatgcggcgcaggaggtggcatatactcttaaacctacttatgacatcgtggtccacgctgaaaggagagatcgtagtcaaccgtttaggccaggggatcagacattaattaattttgggagaggtcagaaggtggcaatgaaccacaattcatatgataagatggttgagggattaacacatttagtgattagagggaaaactcctgaggtgattagagatgatattgcgagcttggatgagatatgtaataggtggatacagagtaggcacgaccccggagagataaaagcatatgaattatgtaaaatattatcaacgattggtcggaaagtcctcgatcgagagaaagaaccagaggacgaggcgaatctatcgatccgatttcaagaggcaatcgacaataagttccgacaacatgatcctgagcgcctgaagatatttgagcataggaatcaacgtagagatgaggaccgattctatattctgttgatgattgcagcctccgatacttttaatacacgagtgtggtggtcgaacccatatccatgtttaagaggaaccttaatcgcgtcagaaacgaagctaggtgacgtttattcgatgatgcgttcatggtatgattggagtgttcgaccaacctatacgccttacgagaaaacgagagaacaggaaaaatatatttatggacgggttaacctgtttgactttgtcgcggaacctgggattaaaattgttcattgggaatataggctgaatcattccacccgggagataacctatgcgcaagggaacccatgtgatttatacccagaggatgatgatgtaatagtcacaaagttcgatgatgtcgcgtatggccaaatgatcaatgagatgataaatgggggttggaatcaagaacagttcaagatgcataaaattttaaaatcggaaggtaatgttctaacgatagattttgaaaaagatgcaaagctaacaaccaatgaaggcgtaacgatgccagaatatttcaataagtggataatcgctccgatgttcaacgctaagctgcgtataaaacatgaagagattgcgcagcgtcaaagtgatgatccgatggtaaaacgtactttatcacctattaccgcagatccaatcgaattgcaaaggttgactttggcgcggttttacgacattcgtcccgctttaagaggacaggcgctttcgcggcaacaggcacagtccacttacgatgaagaaatatcgaaacagcgggattatgcggaaatattgaaacgtcgtggaattgtgcaaatcccaaagaaaccttgcccaactgtgacagctcagtatacgctggagcgttatgctttgttcattataaacatcttacaacagcatgtagcacgagactgcgacgaggaggcgatatacgagcatccgaaagcagattatgaacttgaaatatttggcgagagcattgtggatatctctcaagtgatcgttctagtttttgacttgatatttgagagaagaaggagggtaagagatgtgtatgaatcgcggtacataattgcgcgcattaggaggatgcgaggtaaagagagattgaacgtgatcgcggagtttttcccaacctatgggagtcttctaaatggattaaacagcgctaccgtagtacaggatattatgtatttgaactttctcccattgtattttttagcaggcgataacatgatatactctcataggcagtggtctattcctttacttctatacactcatgaagtgatggtggtcccattagaagttggttcatacaatgatcggtgcggattaattgcgtacctggaatacatggttttctttccctccaaggcgattcgacttagcaaactaaatgaagcgcagcccaagattgcgcgcgagatgcttaagtactacgctaatactgcggtatatgatgggggagtcaactacaacgttgtgacgacgaagcagcttctatatgagacataccttgcttcgttatgtgggggtatttctgacggtattgtctggtatttgccgatcacacatccgaacaaatgcatcgtagcgatcgaggtatctgatgaaagggttccggctagcattagagcggggcgtataaggctaagatttccgctaagcgcgcgacatctaaagggggttgtaatcatacaaattgacgaggagggcgaatttacagtgtatagcgagggaattgtgtctcatcgggtgtgtaaaaagaatttactcaagtatatgtgcgatattatattactgaagttttcggggcacgtttttggtaacgacgagatgctgacaaaacttctcaacgtatgatctgcttgaccgcagatccgcgcactattagacttac

SEQ ID NO: 65 - DNA, 2772 bp, artificial sequence
  VP3 DNA of BTV1
gttaaatttccgtagccatggctgctcagaatgagcaacgtccggaacgaataaaaacgacaccgtatttagagggagatgtgctttcgagtgattcaggaccgctgctttctgtgttcgcgttgcaagagataatgcagaaagtgagacaagtgcaagctgattatatgactgcgacgcgagaggttgatttcacagtaccggatgtacaaaagattctagatgacattaaagcgttagccgcagaacaggtgtataaaattgtcaaagttcccagtatttcgttcagacatatcgtaatgcagtcaagagatcgagtcttacgagtagatacctactatgaagagatgtcgcaggttggagatgttataacggaagatgagccagaaaaattctattcaaccataattaagaaggtacggttcatacgcggaaaaggatcctttatattgcatgatattccgaccagagatcatcgcggtatggaagttgcagaaccagaagtgttgggagttgaatttaaaaatgtgttacctgtgttgaccgccgagcatcgcgcgatgattcagaacgcattggatggatcgataatcgaaaatggaaacgtagccacacgagatgtcgacgtattcataggtgcttgttctgaaccgatctatcgcatatataataggttgcaagggtatattgaggcggtgcagttacaagagttaaggaactcaattggttggttggaaaggttaggacagaggaaaaggattacatattcacaagaagttctaactgactttagaagacaggacacgatttgggttttagctttacagctaccggttaatccgcaagtagtgtgggatgtgccacgcagttctattgccaacttaatcatgaatatagcaacgtgtttacctacaggagaatacatcgcaccaaacccaaggatttcatcgattacgttgactcaaagaattacgacaacggggccgttcgctattctgaccgggtcgaccccaactgcgcagcaacttaatgatgttaggaagatctacttagcgctaatgtttcctggacagattatacttgatctaaaaattgatcccggtgagaggatggatccggcagtaaggatggtcgccggtgttgtaggtcatttactctttacagcaggtggaagatttacaaatctgacacagaatatggcgagacagcttgatatagctttaaacgattatctactttatatgtacaacactagagtccaagtcaattatggtccaacaggtgaaccgttagatttccagattggaaggaatcaatatgactgtaatgttttcagagcagatttcgcgacaggaacaggatataatggatgggctacaatagatgttgagtatagagatccagccccttatgtgcatgcacaacgctacatacgttattgtggcattgattcgcgtgagttgatcaatccaacaacatatggcattgggatgacttatcattgctacaacgagatgttgcgaatgctagttgctgcagggaaagattctgaagcggcgtactttcggagcatgttaccctttcatatggtaaggttcgctagaataaaccaaatcataaatgaagatttacactctgtgttctcgttgccagacgatatgttcaacgcattattacccgacctaatcgccggggcgcatcagaacgccgacccagtcgtgctagatgtgagctggatatcgctgtggtttgctttcaacagatcatttgagcctacgcatagaaatgagatgctcgagattgctccgctgatcgaatccgtttatgcgtctgagttatccgtgatgaaggtagatatgcgacacttatcattgatgcagagaaggtttccagatgttttaatccaagcgaggccatctcacttctggaaggcagttctaaatgatagtccagaggcggtgaaagcagttatgaacttgtcgcattcgcataatttcatcaatataagagatatgatgcgttgggtgttgctcccgtcgctgcagccatcgttaaagctcgttttggaagaggaggcatgggctgctgcaaacgatttcgaagatctaatgcttactgatcaagtttatatgcaccgagatatgttgccggagccacggttggatgatattgagaggtttaggcaggagggcttctactacacgaatatgttagaagcgccaccggagatagatcgtgtggtccagtatacttatgaaatcgcacgtctgcaggcaaacatggggcaattccgagcggctttaagacgtattatggatgatgatgactgggtaaggtttggcggtgtgctacgcactgtacgcgttaaattcttcgatgcgcgacccccagacgatattttgcaaggcttgcctttcagttatgatacgaatgagaagggtggattatcatacgcgacaatcaagtatgctactgagaccacaattttttatctgatatataatgttgagttctcaaatacacccgactccttggtattgataaacccgacatatacgatgactaaagtcttcattaataagagaatcgttgagcgagtacgggttggacagattctggctgtattgaacagaagatttgtggcatataaaggaaaaatgaggatcatggacatcacccaatcgctcaagatgggcaccaagctggctgcgccaactgtgtaggtgcgcgaccaatctatgcacttggtagcggcagcgggaacacacttac

SEQ ID NO: 66 - DNA, 1981 bp, artificial sequence
  VP4 DNA of BTV1
gttaaaacatgcctgagccacacgcagtactctatgtcacaaacgagctctctcatatcgtcaagagtggatttttgccaatatggagattaactggagatgagagtctgaacgatttatggcttgaaaatggaaaatatgcgacagatgtatatgcatacggagatgtatcaaaatggacgatacgacaactacgaggtcatgggttcattttcgtaagtacacacaagaatatacagctggctgatatcattaaaacggtcgatgttcgtattcctcgggaagtcgcaaaaagtcaagatatgaaagcatttgaaaatgaaattggtagacgcagaatccgtatgcgtaaaggatttggtgatgcgctgaggaattacgcctttaagatggctatcgaatttcacgggtcggaagcggagacgttgaacgatgcaaatcctcgattgcataaagtttacggaatgccagagataccgccgctatacatggaatatgcggagattggaactagatttgacgatgagccaactgatgaaaagttagtatcgatgcttgattatatcgtttacagcgcagaggaggtgcactacgttggatgcggtgacttacgtaccttgatgcagtttaaaaaacgttcaccaggacggtttagaagagtattatggcacgtatatgatccaatagcgccagaatcttcagatccaaacgttatagttcataacgttatggtagattcaaagaaagacattttgaaacatatgaactttttaaaacgtgttgaaagacttttcatatgggatgtgtcatcagatcgatcgcagatggatgatgacgaatgggaatcgaccagattcgcagaggacaggttgggtgaggagatagcttatgagatgggtggtgcgttttccagtgcattgattaaacataggataccaaattcaagagacgagtatcactgcatttcgacttaccttctcccccagccgggggctgatgcggatatgtacgaattaagaaattttatgagattgaaaggttactcacatgtagatcgccacatgcatccagatgcctccgtgatgaaagtcgtttcgcgtgatgtacgcaaaatggtcgaattgtatcatggccgcgatcgtggcagatttctaaagaaaaggctatttgagcacctccatatcgtacgtaagaatgggttgctgcatgaaagtgatgaaccacgagcagatctgttttatttgaccaatcggtgtaacatgggattggaaccaagcatttatgaagtaatgaagaagtcggtgatcgctacagcctgggtaggccgtgctcctctatatgattatgatgattacgcgttaccccgatctactgtcatgctcaatggatcttaccgtgatatcagagttctagatggtaatggcgcaatcctatttctaatgtggaagtacccagatattgtgaagaaagatttaacatatgatccagcgtgggcgatgaattttgccgtctcgttaaaggagccgatacctgacccccctgtgcccgatatctccctatgtagattcatcggactgcgcgttgagtcatctgtgttgagggtccgaaacccaacattacatgaaacggctgatgaactaaagcggatgggattggatttgtctggtcatctatacgtcacattgatgtccggcgcttatgtcacagatctgttctggtggtttaagatgattctcgactggtctgcgcaaagcaaggaacaaaaattacgtgatttaaagaggtctgcagcggaggtaatcgaatggaaggagcagatggccgagcgtccatggcacgtgagaaatgatctaattgcagcgctgagggagtacaaacggaaaatggggatgagagagggagcctcgatcgattcgtggctagaattactgcgtcacttataatgcgtgactgctaggtgaggggggcatgtacaacttac

SEQ ID NO: 67 - DNA, 1635 bp, artificial sequence
  VP5 DNA of BTV1
gttaaaaagtgcgcccttagcgaagatgggtaaagtcatacggtccttaaaccgatttggcaaaaaggtaggcaacgcgttaacttctaataccgcaaaaaagatctatagtacaattggaaaagcggcggagcgatttgctgagagtgagataggttcagcggcgatcgatggattagtacagggaagcgtacattcaatcataacgggcgaatcttacggcgaatctgtgaaacaagctgtgttgttaaatgtgttggggagtggtgaggaaattcctgatccgctaagtccaggagagcgagggatacaagctaagttgaaagagttagaggacgagcaacgcaatgaattagttcgcttaaaatataatgataagattaaggaaaaatttggaaaagagcttgaagaggtttacaattttatgaatggagaggcgaatgctgagattgaagatgagaagcagtttgatatactgaacaaggcggtgacctcgtataacaaaattcttacggaggaagatctacagatgcgccggttagctacggcgctgcagaaagagatcggagaaagaacacatgcggagacggtcatggtgaaagaataccgcgataaaattgacgctttaaaaaatgcgattgaggtagaaagagatggcatgcaagaggaggcgatacaggagatcgcggggatgaccgcagatgtgttagaggcggcatcggaggaggttccgctgattggtgcggggatggccacagctgtggcgacagggagggctattgagggagcgtacaaactcaaaaaagtgatcaatgctttaagcgggatcgatttaacgcatttacgcactccgaaaatcgaacctagtgttgtttcaactattcttgagtaccgcgcaaaggagattcctgataacgctctggctgttagtgttctatcaaagaatcgtgcgattcaagaaaaccacaaagaactgatgcatattaagaatgagatattaccgagatttaagaaagcgatggatgaagaaaaggaaatatgcgggatagaagacaaagtgatccacccgaaggtcatgatgaagtttaagattccaagagctcaacagccgcagattcatgtatacagtgccccatgggattctgatgatgtgtttttctttcattgcatctcacaccatcatgcaaatgagtcgttcttcttaggtttcgatttgagcattgacttagttcattatgaagatctcaccgcccattggcatgcattgggagcagctcaaacggcagcgggacgtacgctaactgaagcatatagagagtttctaaatttggcgatttcaaatgcatttggcacgcaaatgcacacgagaagattggttaggtcgaaaacggtacatccgatttacttaggttccttgcactacgatatttccttttcggatctgcgtggaaacgctcagagaattgtttatgacgatgaactgcagatgcacatacttcgtgggccgatacattttcagagacgggcaatactaggggctttgaaatttggatgtaaggttttgggggaccgtttagacgtaccactcttcttacgaaatgcttgaacgcagcgacgggaagcacttacacttac

SEQ ID NO: 68 - DNA, 1772 bp, artificial sequence
  NS1 DNA of BTV1
gttaaaaaagttctctagttggcaaccaccaaacatggagcgctttttgagaaaatacaacatcagtggggattacgcaaatgccacgagaacttttttggctatttcaccacaatggacttgcagtcatctaaaaaggaattgtttattcaatgggatgtgtgttaaacaaaattttgagagagcaatgattgcggcaaccgacgtggaggagccggcgaaagcatataaattagttgaattggcaaaggaggcaatgtatgatcgggagacagtctggctccaatgcttcaaaagcttttcccaaccatacgaagaggatgtcgaagggaagatgaagcgatgcggggtgcaactgctcgaagattaccgcaaaagtgggatgatggatgaggccgtgaagcaatccgcattggttaattcggaaagagttagattggatgattctctttctgcaatgccttacatctatgtgccaattaaagagggtcaaatcgtgaatccaacatttatatcaagatatcgccaaattgcatactatttctacaacccggatgcggctgatgattggatcgatccaaacttgtttggtattcgcggacagcacaatcaaatcaaacgtgaggttgagagacaaattaacacatgtccctacactggatacaaaggcagagtatttcaagtgatgttcttgccgattcagctgatcaatttcttaaggatggatgattttgcgaaacattttaacaggtatgcttcgatggcgatacagcaatatttgagagttggttatgctgaagaggtcagatatgtgcaacaactttttggaagggttccaacgggcgaatttccattacatcaaatgatgctgataagacgcgatttcccaacgcgcgatcgcagcattgtggaagcgcgggtgaggagatcgggtgatgagaactggcaaagctggctgctacctatgattattgttcgtgaaggattggatcacccggatcggtgggaatggcttattgattatatggatagaaagcatacatgtcagctgtgctacttgaaacactcaaagcagatcccgacctgtggtgtgattgatgtacgcgcatcagaactaactgggtgttcgccattcaagacggtgaagattgaggaacatgtgggaaatgattcggtttttaagacaaaattagttcgcgatgaacaaattggcaggatcggagatcattattatactacaaattgttacactggggcggaggccttgattacaactgcgattcacattcaccgctggattagaggctgtggcatctggaacgatgagggatggcaggagggtattttcatgctcggacgcgtactactgagatgggagctgacgaaggcgcagcgcagcgctctgctcaggttattctgctttgtgtgctacggatatgcgccgcgtgcagatgggacgataccggattggaataaccttggaagctttttggatatcattttgaaaggaccggagctcagcgaggatgaggacgagagggcttatgctacgatgtttgaaatggttcgatgcattatcaccctatgctatgcagaaaaggttcacttcgctgggttcgcggcacctgcgtgtgagagcggggaagttatcaatctcgctgctcgtatgtctcagatgtggatggagtattagttactgacttctgttttctgtttcttcttttttcttcttctattttctcttagcactctactagaacttttcaacttac

SEQ ID NO: 69 - DNA, 1156 bp, artificial sequence
  VP7 DNA of BTV1
gttaaaaatctatagagatggacactatcgctgcaagagcacttactgtgatgcgagcatgtgctacgcttcaagaagcaagaattgtgttggaagctaacgtgatggagatactggggatagcaatcaacagatataatggattaactttacgaggggtgacgatgcgcccgacctcattggcgcagagaaatgagatgttttttatgtgtttagatatgatgctgtccgcggctgggataaacgtaggaccgatatctccagattatacccaacatatggctacaattggtgtactagcgacgccagagataccttttacaacggaagcggcgaatgagattgctcgcgtgactggggagacttcgacgtggggaccagcgcgtcagccctatggttttttccttgaaactgaagagactttccaacccgggagatggttcatgcgtgccgctcaagcagtaactgcggtagtgtgtggtccggatatgattcaagtgtcactgaatgctggagcaagaggagatgtgcagcagatatttcagggtcgtaacgaccccatgatgatatatctagtttggagaagaattgaaaacttcgcgatggcgcagggtaactcacagcaaactcaagcaggcgtgactgttagcgttggtggagtagatatgcgggcggggcgtatcatagcgtgggatggacaggctgctctacatgtgcacaatccaacacaacagaatgcgatggttcagatacaagtcgtgttctacatttctatggataagaccttaaatcaataccctgccttgactgctgaaatctttaatgtttatagcttcagagatcacacatggcacgggttgaggacggctatactgaacagaactacactgccgaatatgctgccacccatctttccaccaaacgatcgagatagtatcctgactcttttgcttttgtctacgcttgctgatgtttatactgttttaagacctgagttcgcgatccacggcgtaaacccaatgcctgggccgctcacacgtgctattgcacgcgccgcctatgtgtagtccactttgcacgggtgtgggttacatatgcggtgtgtcggttgtgggatatatgtgacccattcaaacgtctcttagattacacttac

SEQ ID NO: 70 - DNA, 1125 bp, artificial sequence
  NS2 DNA of BTV1
gttaaaaaatccttgagtcatggagcaaaagcaacgtagatttactaaaaacatttttgttttggatgcaaatggcaaaacattatgcggagcgatcgcaaagttgagttcgcaaccgtattgtcaaattaaaattggaagagtaatagcttttaaacctgtcaaaaatccggaacctaagggatacgtgctgaatgttccaggacctggtgcgtacagaattcaggatgggcaggatatcatcagcctgatgttgacaccacatggggttgaagcgacaacggaaaggtgggaagagtggaagtttgagggtgtcagtgtaacgccaatggctactagggtacaacataatggtgtaatggttgatgctgagattaagtattgtaaaggaatgggaatagtgcaaccatatatgcggaatgattttgatcggaacgagatgcccgatttaccaggtgtgatgaggtcaaactacgatgttcgtgaactgcggcaaaagatcaaaaatgaacgagaatcagcgccacggcttcaagttcaaagcgtggcgccaagggaagagtcacgctggatggatgatgatgaagcaaaggtggacgaagaggctaaagagatgattccgggaaccagcagattggagaagctgcgtgaagcgagaagcaatgttttcaaggaggtggaagctggaatcaactggaatctggatgagaaagatgaagaggatagagatgagcgggaggatgaggagcaggtgaagactctgagtgacgatgatgaacaaggtgaggatgcgagtgacgatgaacacccaaaaactcatataactaaggaatacattgagaaggttgcaaagcagattaaattaaaggatgaacggttcatgagtctatcaagcgctatgcctcaggcgagcggtggatttgatcgtatgattgtcacgaagaagcttaaatggcagaatgtgccattatactgttttgatgagtcatcgaaaaggtatgagttacagtgtgtgggtgcgtgtgagcgtgttgcttttgtctctaaggacatgagcttgatcatattgccggtcggcgtttaggcgcttgtgaccgcgtggttagggggggattttacacttac

SEQ ID NO: 71 - DNA, 1049 bp, artificial sequence
  VP6/NS4 DNA of BTV1
gttaaaaaatcgcatatgtcagctgcgatgcttcttgcacccggtgacgtgatcaagcgttcatccgaggagttaaaacagagacagatccaaattaatttaattgattggacagagggcgagagcgaaaaagagagtaaagcggaagccaaagagggagacaaagcagaggaattaaaagatggtgaggggacgcaatcggagagcagccagaagaaagagagcagcaaagagactaaagatgcagatgtggatagacgcatacatactgcagtgggatctggatcaagcgcaaaaggacctggagaacgcgcgaacgagaatgttgacagaggagatggaaaggttggaggaggaggtggagatgctgatgcgggagttggaactactggagcgaatggaggaagatgggtagttctaacagaagagattgctcgcgcgatcgaatctaaatacggtacgaagattgatgtttacagagatgaggtcccagcacaaatcatcgaagtagaacgcagtctccagaaagagctagggatttcgcgtgagggagtggccgagcagacagagagattgagagatctgcgacgaaaagagaagagtggggcacatgcaaaggctgctgagagagggaggcgtaaacaagggaagaagcctcatggtgatgcgcagagagagggtaccgaggaagagaagacgtccgaagaaccagcgagtgtcgggatcactatagagggggtcatgagtcagaagaaactcttgagcatgattggcggtgtagagagaaagatggctccaataggcgcgcgggagagcgcagttatgttagtttcaaacagtattaaagatgtggtgcgagctacagcgtatttcacagcgccaaccggagatccacattggaaggaggtggctcgcgaagcttcaaaaaagaagaacatattagcatacacgagtacgggaggagatgtgaaaacggagttcctgcatttgatcgatcacctctaaagggtccagggtaccttcttgacgtagggcgattttacacttac

SEQ ID NO: 72 - DNA, 822 bp, artificial sequence
  NS3 DNA of BTV1
gttaaaaagtgtcgctgccatgctatccgggctgatccaaaggttcgaggaagaaaaaatgaaacataatcaggaacgggttgaagagctgagtctggtccgtgtggatgacacgatttcccaaccgccgagatatgctccgagtgcgcctatgccatcgtcgatgcctactgttgcacttgaaatcttggacaaagcaatgtcaaatacaacgggtgctacgcaaacacaaaaagcggagaaggctgcattcgcatcgtacgcagaagcgtttcgtgatgacgtgaggttgagacagattaaacgacatgtaaatgaacaaattctgccaaagttgaaaagtgacctaggaggcttaaagaagaaaagagctataatacatatgacattactgatagcggcggttgttgctctgttgacatcagtttgcacgttatcgagtgatatgagcgtggcgtttaagctaaatggtacatcagctgagatacctcaatggtttaagagtctgaacccaatgttaggtgtggtgaatttgggggctaccttcctgatgatggtctgcgcaaaaagcgagagaagcttgaaccagcaaattgacatgattaagaaggaagtgatgaagaaacaatcatataatgatgcggtgaggatgagctttacggaattttcatcagtcccgctagatggtttcgaattaccattaacctaagatcagtaggtagagtggcgccccgaggtctgcatcgtgtagagtggttgatctcacgatgcagactcctactgctgtctaacgggggagggtatgcggcgctacacacttac

SEQ ID NO: 73 - DNA, 2939 bp, artificial sequence
  VP2 DNA of BTV8
gttaaaatagcgtcgcgatggaggagctagcgattccgatttatacgaatgtattcccagcggagcttttagatggatatgattacatcattgatgttagtagtcgtgttgaagaggaaggtgatgagcccgttaagcgacacgatgtaacagagattcctaggaattcaatgttcgatattaaggatgaacatatacgtgatgcgattatatacaaaccagtcaacaatgatgggtacgtactaccgagagtattagatatcacgctgaaagcctttgacgaccggaaaagagttgttttgaatgatggtcatagcgaatttcatacgaaaacgaattgggttcagtggatgattgatgacgcaatggatgtccaacctcttaaggtagatatcgctcacacgcgctcgaggatcagccacgcactctttaactgtacggtgcgattgcattcaaaaaaggctgacaccgcatcttatcacgttgaaccagttgaaattgaatcgtggggatgtaaccacacatggttgagtaggattcatcatctagtgaatgttgaattatttcattgttcacaagaggcggcgtatacattgaaacccacatataagataatatcaaatgcggaacgtgcatcaacgagtgattcctttaatggaactatgatcgaattaggtcgtaatcatcaaattcagatgggtgaccagggataccagaagttgaaagaagggttggtacaagttcgaattgaagggaagacgcctttggtaatacaagaggaaataaccgctttgaataaaataagagaacaatggatcgctcgaaatttcgatcaaagggaaatcaaggttttagatctgtgtaggttgttgtctacgataggtaggaagatgtgcaatactgaagaggaacctaagaatgaagctgatctttcagtgaagttccaaatggagcttgacgaaatatttcgaccgggaaataacgagcgtaccaacatcatggggggcggagtacatcggaaaaacgaggacagattttacgtactaattatgatcgctgcatccgataccaataaaggtcgtatatggtggagcaatccgtatccctgcctgcgtggagcgttaatcgccgctgaagtccaattgggtgatgtttacaatcttttaaggaattggttccaatggagcgtacgacctacctatgtaccttacgataggaatagagaaagtgataagtatatttatagtagaatcaatttatttgattcaaccctgagaccaggcgacaaaatagtacattgggagtataagttgcttaatgaagtacgagaggttagcatcaacaaaggtaatgagtgcgatctgttccctgaggatgaagaatttaccaccaagtttcatgaggcgcggtatacggagatgaagaaccaaattattcaaagcgggtggaatcaacgagattttaaaatgcataaaatactagaggatggcgcaaatgtgttaacgattgattttgagaaggacgcgcacatcggcacgggttcggccctgagtttgccggattactataacaaatggataattgctccgatgtttaacgctaagttacgcattaccgaggttgtgattggaacggctcacaccgacgatccagctgtagggcgcagcgcgaaggcgttcacacatgatccttttgacctgcagcgatattgtctagcaagatactatgatgtacgacctggtatgatgggccgcgctctctctaagcaacaaaatatgtcgtcgatgactgataaactctctaagcaggaggattacgcagggattgtttcaaggcgtctggaatacaaggaacgagagaacagatgcttgacggagacagcgcagtatgtattcgagaaaacatgcttatacgtactagaattattgagcagacatacgatgccctcggaggattctgaagtaacgtttgaacacccaacaattgatcccagcgtcgatattgaaacgtggaaaataattgatgtttcgcaactgatcatattcgtatttgactatttatttgaaaatcggaagatcgtgagggatactaccgaggcaaggtggacgcttttcaaaataagatcggaagtaggacgagccaggattgacgcaatagagatgacttttcctcggtttggacgtatgctaagaaatgcgtctcaggcaaagataaatcaagatatcgcgtgcttgaacttccttccactacttttcatcataggcgataatatatcttacgcacatagacagtggagtataccggtgctgctgtatgcgcacgatatccgaattatacctttggaagttggagcgtacaataatcgttttgggctgacgtcatacctagagtatatggctttctttccatcgtacgctactagagtagctaaaattgacgagtcgatcaaggagtgcgcgatcgcaatggctgagttttatatgaacaccgatatccacagtgggagtgtgatgagtaacgtgataacgaccaagcggctattgtatgaaacatacttagcttcgctatgcggcggttattcggatggattgctttggtacctgccaattacacatccctcgaaatgcttagtcgcctttgaggtagctgatgacgtagttccactctcagtaaggcgggaacgtattctatctaggtttcctttaagctcgagacatgtcaaggggattgcgttgatttcggtggataggaatcaaaaggtatcggttcaaacagagggtattgtaacacatcgtctctgtaaaaagaatctgttaaaatacgtgtgtgatgttattctttttaagttttctggacacgtttttgggaatgatgagatgttaactaagctgctcaatgtatagctctcgtgactgagagctcgcgcgctatcaacttac

SEQ ID NO: 74 - DNA, 1637 bp, artificial sequence
  VP5 DNA of BTV8
gttaaaaaagcgatcgctctcgcgaagatggggaaaatcataaagtccctaagccgattcggaaagaaagttggaaacgccttaacatcaaacacagcaaaaaagatttatagcacaattggaaaagcggctgaacgatttgcagaaagtgaaatcggctcagcggctattgatgggttagttcaggggagtgtacattcgttgatgacgggagagtcttacggcgagtcggtaaaacaagctgtgctattaaatgtaatgggaagtggtgaagagcttccagatccactaagtccgggtgaacgtggaatgcagacaaagatccgtgaattggaggatgaacagcgtaatgagttgattcggttgaagtataatgataagataaagcaaaaatttgggaaagaattagaagaggtatatgagtttatgaatggggttgcgaagcaggaggaagacgaagagaaacattatgatgttctcaaaaaagcggtaaactcgtacgataaaatcttaaccgaggaggaaaaacaaatgaggattttagcaacagcgttacaaaaggaggtgaaggagcggacggggacggaggccgtcatggtaaaagagtatcgaaataagatcgatgcgttaaaagaggccatagaggtagagcgtgatggaatgcaggaagaggcgattcaggagatagctggaatgacggcggacgtattggaggcggcttcggaggaagtgccactaataggtgcggggatggcgacagctgtagctacaggtagggccatcgaaggagcttacaaattaaagaaggttataaacgctctcagcggaatcgatttgactcacttaagaacaccgaagattgagcctacgatagtatcgactgtgttggatcataagtttaaggatattcctgatgagatgctcgcggtaagcgttttatcaaagaatagagccatcgaagagaaccataaagagattatacatcttaagaacgagatattgcctagatttaagaaggcgatggacgaggagaaggagatatgtggaatcgaagacaaaaagatacatccgaaagtcatgatgaaattcaaaattccgcgaactcaacagccccaaatccatatatatagtgcaccgtgggattccgacgacgttttcttttttcattgtatatcgcatcaccacgcgaatgaatcattttttattggatttgacttaggcatcgatctggttcactacgaagatttgactgctcattggcacgctttgggtgcggcgcaggcggcggttgggaggagtctgaatgaagtgtacaaagaatttttgaacctagcgattaataacacgtatagctcgcaaatgcacgctcggaggatgatacgatcgaagactgtacaccccatatatctaggctcactccattatgatatttcgttttcgacattacggagcaatgcgcagagaattgtgtatgatgaggaattacagatgcacatattgaggggaccactacatttccaaaggcgggcgatactaggcgcgataaaacatggagttaaaatcttagggacggaggttgatatcccactcttcttaagaaatgcctgagcgcagcggagccaccgctttccacttac

SEQ ID NO: 75 - DNA, 2940 bp, artificial sequence; identical to SEQ ID NO: 64
  VP2 DNA of BTV1 for sBTV FJ969720

SEQ ID NO: 76 - DNA, 1635 bp, artificial sequence; identical to SEQ ID NO: 67
  VP5 DNA of BTV8 sBTV FJ969723

SEQ ID NO: 77 - DNA, 2943 bp, artificial sequence
  VP2 DNA of BTV2 JN255863
gttaaaacaggatcgcgatggatgaacttggcattccgatttatggacgtaactacccagagcatttattaaaaggatatgagtttttgattaataccggcgtgagatatccaagtcaaggtggacgtcatgatgtttccaagattcctgagatgtttgcttacgatatcaaagatgaggggatacgggaagcactcaaatatatgccaacacgaaatgatggggtggtcctgccaaggatcgttgacattagcttgaagggatatgatatacggaaatcagttattgaagcgaataagagtaacagcttccatactgacacaaactgggttcagtggatgattaaagatagtatggatcaacagccgcttaagatatcgattgacgaggaacatagccgggttgtacactccctatttaattgtcaagtgaagattgatgcgaaaaaagcagataccttatcttaccatctcgaagcaattgaagatgcagagaaagcatgtttgcacacgaggggtcaattatgtaatcatctggcgaggatggatctgttacacgcggcacaagaaattgcgtatgcaattaagccgacgtatcagttaatagtgcattcagagagagcgtcaacttcagataacttcgaattagggaggcaggatgtaattactttgagaaggggacatagaatacaaatgggtgacgaagcgtatactaagctgatggaacgtttagtgaggttaacggtgcaagggaatgtgccgagaaagatacaaagtgagatagagcagcttgaggcgattcgaactaggtgggcaactggcagatatgatccagctcatatcaattcacaagatctgtgtcggatattgtcacgcataggcagaattatgttggaccaagaagcggaaccggttgatgaagatagcttatctttgcggtttcagcgagctctcgatgagaagttccgtcttaacgattctgagagaaataagatatttgagcccaaatcgcataggaaggatgaggataggttctacgttttgttagctatcgctgcttccgacacttacaattcgagaatttggtggtcaaatccgtatccatgcttgcgcggcacgttgattgcggcggagacaaaattaggcgatgtttactttactctacgatcttggtatgactggagtgttagaagtagctatgtaccgcgtgaaagagagcgggaaacggagaagtatatatttagtaagataaatctatttgattacgaagctggtccatcgagcaaggtcatacattgggaatatcagttatataaacgagagcgggtggttaccctagagagaggcaatccttgtgacctgtatcctgatgaagatgatgaagttattatcacgaaatttgatgacgccaaatactctgagatggtcggggaaattatagatggtggatggaatgatgaggaatttaaaatgtataagttacttcaggaaaaaggcaatgttctcacaattgacttcgaaaaggatacgaagctgaatagtacttcagaggtggttttaccggattattatggtaagtggatagttgcgccgatgttcaactctaaaatgagaattattgaaacggagatcgcaaccaacagaagtgatgatcccatgattaaaaggacgctcaaaccgatgactgatgatcccgttgagctacagagatatactttggccagatactatgatattcgtcccggactaatgggtcgttcgctaaataggacacagactcaatcaacatttgacgcgaaggtgtcagaattgtccgactatgaaaaggtggtgtcacggtttggtgtaatcaagaaaccgacaagaccttgcgtaactttgactggacgatacatcctggagaaatattctttacttcttatagatatattgaagtatcatactgaggttgaagagaatccacaagaagaatttactcatccgaggattgattcacagtttaaattcaacggtaatacattatctgatctgaatcaaacggtcgttttcatagtggattatttgcatgagaagcgtaactatgtacgatcggtatacgaggcgagatacattatatctaggataaggtcgtctaccggtgcggcgcgtatgagtatcctcgaattttatttcccaacattcgcacgcttgatttcgaatgcgcgggaaccgacttatgtgaaagatctgatggcgttgaacttcttgccgttactattcatagtaggtgataatatgatatataaacataggcagtggtcgataccattattactgtatacagaccgagtgaaggtgattccattggaagtgggctcatcgaacaatagacagggactcgtatcctatctagagtatatgttcttttttccatcgttagctgatcgaacatctaaggtggatgaatcgatgattaaggtgtcaaaggaggtggttaattactatatgaaaacaacaatatcggaagggggcgtgaatttgaatgttgtttccaccaagtcattgctatatgacatctatctctcatcagtgtgcggtggtgtgtcggatggtgtagtctggtacctaccgatcactcatccatataaatgtgtagtcgctattgaggtgtgcgacgatagagtgcccgcgcgcttacgttgtgatagattgaggttgcgtttccccttaagtgcacagcatttaaagggtatagtagtgattcaaataaatgaggagggcggatttgatgtgtatacagaggggatagtaacgcatagggtttgtaagaaaagtttacttaaacatgtatgcgacattgttctactaaaatttcatgggcacgtctttgggaacgatgaaatgctaacaaagttactcaatgtatgacctgcgtgactgcaggtccgcgatctgttcaacttac

SEQ ID NO: 78 - DNA, 1635 bp, artificial sequence
  VP5 DNA of BTV2 JN255867
gttaaaaagtgtacccttagcgaagatgggtaaagtcatacgatctctgagcagatttggaaagaaagtaggtagcgcgctcacgtctaacacggcaaaaaagatctatagtacgataggcaaagcagccgagagatttgcggagagcgagatcggttcagcagcgatcgatggtttagtacagggcagtgtacactcgatattgacaggtgagtcttacggtgaatcagtcaaacaggcggtcctactaaatgttctgggtagcggcgaagagattccagatccgctaagcccgggggaacaaggtatacagactaaattgaaagaattagaggaggaacagagaaatgagctggtacgattaaaatataatgataaaattaaagaaaagtttggagaggagctggagcaggtatatgaatttatgagtggtgcggcaaaagaagaggcgggggatgagaagcagttcgatatcttaagtaaggcggtgaattcgtacaataagatattaactgaagaggacctacaaatgcgtcggctcgcgatcgctttacagaaggagattggtgagaggacacacgcggagacaactatggtaaaagagtatcggaataagattgacgctcttaagagcgctatagaaattgaaagagacggcatgcaggaagaagcgatacaagaaatagcggggatgactgctgatgtcttagaggcagcatctgaagaggtgcctctgatcggagcgggcatggcaacggctgttgcgacgggaagagcgattgagggagcgtataagttgaagaaggtaattaacgcattaagcgggatagatctaacacatcttcgtacgccgaaaatcgagcctagcgtagtctctacaattttggagtatcgcgcgaaggatatcccggataatgcgcttgcagttagcgtgctgtcgaaaaatcgcgcgattcaagaaaatcataaggagttaatgcatatcaaagatgagatcttaccccgttttaagaaagcgatggatgaagagaaggagatctgtggaattgaggataaagtaatacatcctaaagtaatgatgaaatttaaaattccaagatcacagcaaccgcaaattcatatttatacggcgccatgggattctgatgatgtattctttttccattgtatttcacatcaccacgccaatgaatcattttttatcgggtttgatttgagcattgatttggttcattatgaagatttgacggctcattggcacgcactgggggcggctcagatggccgtaggacgcacgctaaccgaagcgtataaagaattcttaaatttggccatttctagcacgtatgggacgcaaatgcacactcgaaggttaattaggtcgaaaacggtgcatccgatttatttgggttctctccattacgatatttcttttgctgacttacggggaaacgctcaacgcatcgtatacgatgatgaattacaaatgcatatcttgcgtggtccgctacattttcaaagacgagctatactaggtgcgctaaagtttgggtgcaagatacttggagatcgattggacgtgcccctcttcttacgaaatgcttgaacgcagcgacgggcagcacttacacttac

SEQ ID NO: 79 - DNA, 2943 bp, artificial sequence
  VP2 DNA of BTV2 AJ585123
gttaaaacaggatcgcgatggatgagcttggcattccaatttatggacgtaattacccagagcatttattaaaaggatatgagtttttgattaatactggtgtaaaatatccaagtcaaggtggacgtcatgatgtttccaagattcctgagatgtttgcttacgatatcaaagatgaggggatacgggacgcactcaaatatatgccaacacgaaatgatggggtggtcttgccaaggatcgttgacattagcttgaagggatatgacatacggaaatcagttattgaagcgaataagagtaacagcttccatactgacacaaactgggttcagtggatgattaaagatagtatggatcaacagccgcttaagatatcgattgatgaggaacatagccgggttgtacattccctatttaattgtcaggtgaagatcgatgcgaaaaaagcagataccttatcttaccatcttgaagcaattgaggacgcagagaaagcatgtttacatacgagaggtcaattatgtaatcatctgacgaggatggatctgttacatgcggcacaggaaattgcgtatgcaattaagccgacgtatcagttaatagtgcattcggagagagcgtcgacttcagataacttcgaattagggaggcaagatgtaatcactttaagaaggggacatagagtacaaatgggcgacgaagcgtatactaagctgatggaacgcttagtgaggttaacggtgcaaggaaatgtacccagaaagatacaaagtgagatagagcagcttgaagcgattcgaaccagatgggcaactggcagatacgacccagctcatatcaattcacaggatctgtgtcggatattgtcacgtataggcagaattatgttggatcaagaagcggaaccggttgatgaagatagcttatctttgcgatttcagcgagctctcgatgagaagttccgtcttaacgattctgagagaaataagatatttgagcacaaatcgcataggaaggatgaggataggttctacgttttgttggctatcgctgcttccgacacttacaattcgaggatttggtggtcaaatccgtacccatgcttgcgcggcacgttgattgcggcggagacaaaattaggcgatgtttactttactctacgatcctggtatgattggagtgttagaagtagctatataccgcgtgaaagggagcgggaaacggagaagtatatatttagtaagataaatctatttgattacgaagctggtccatcgagcaaggttatacattgggagtatcaattatataaacgagagcgggtggttaccctagagagaggcaatccctgtgacttgtatcctgatgaagatgatgaagtcattatcacgaaatttgatgacgctaaatactctgagatggtcggggaaattatagatggtggatggaatgatgaggaatttaaaatgtataagttacttcaggaaaaaggtaatgttctcacaattgacttcgaaaaggatacgaagctgaataatacttcagaggtggttttaccagactattatggtaagtggatagttgcgccgatgttcaactctaaaatgagaattattgaaacggagattgcaaccaacaaaagtgatgatcccatgattaaaagaacgctcaaaccgatgactgatgatcccgtcgagctacagagatatactttagccagatactatgatatccgtcctggactaatgggtcgttcgctaaataggacacagactcaatcaacatttgaccccaaggtgaaaaagttgcccgactataaaaaggtggtgtcacggtttggtgtaatcaagaaaccgacaagaccttgcgtaactttaaccgggcgatacattctggagaaatattctttacttcttatagatatattgaagtatcatactgaggttgaagggaatccacaagaagaatttacccatccgaggattgatccacagtttaaattcaacggtaatacattatctgatctgaatcaaacggtcgtttttatagtggattatttgcatgaaaagcgtaactatgtacgatcgatatacgaggcgagatacattatatctaggataaggtcgtctaccggtgcggcgcgtatgagtatcatcgaattttatttcccaacatttgcgcgcttgatttcgaacgcgcgggaaccgacttatgtgaaagatctgatggcgttgaacttcttgccgttactattcatagtaggtgataatatgatatataaacataggcagtggtcgataccattattgctgtatacagaccgagtgaaggtgattccattggaggtgggctcatcgaacaatagacagggattcgtatcttatctagagtatatgttcttttttccatcgttagctgatcgaacatctaaggtggatgaatcgatgattaaggtgtcaaaagagatggttaattactatatgaaaacaacgatatcggaaggggccgtgaatttgaacgttgtttccaccaagtcattactatatgaaatctatctctcatcagtgtgcggtggtgtgtcggatggtgtagtctggtatctaccgatcactcatccatataagtgtgtagtcgctatcgaggtgtgcgacgatagagtacccgcgcgtttacgttgtgatagattgaagttgcgttttcccttaagtgcacagcatttaaagggtatagtagtaattcaaataaatgaggagggcggatttgatgtgtatacagaagggatagtaacgcatagggtttgtaagaaaagtttacttaaacatgtatgcgacattgttctgctaaaatttcatgggcacgtctttgggaacgatgaaatgctaacaaagttactcaatgtatgacctgcgtgactgcaggtccgcgatctgttcaacttac

SEQ ID NO: 80 - DNA, 1635 bp, artificial sequence; identical to SEQ ID NO: 78
  VP5 DNA of BTV2 JN255867

SEQ ID NO: 81 - DNA, 2935 bp, artificial sequence
  VP2 DNA of BTV3 AJ585124
gttaaaaacgctgtcccgagaatggaggagctggtaatacctgtgatttcacgacaattcgataagaaactagtggggcgttacgagtacgtgatagaattagctgaaccagagcaggatgagtggacgaatcacgacgttacacagataccaggcaggcggatgtttgatgtagcgcagcaaggcatcagggaggcaatcatttataagccgctggataatgatggtgaggttttacctcgcatcttagatatgtcaatcgcgtgttatgacatgaggaaaaccatgatgaagaaggaaggtgtcgattttgtttcgaacacgagatggcttgagtggatgattcaagattcgatggatgtacagccattgcgtgtccagatgaaggaagatcatagtacggttcagtatgacatgttttcagcgaaagtgcacatcgattctagaaaagcggacaccacatcgtaccacgcaatcgctgttgagacgaaagccgagcgtaaatgttgccatgtgcgtacagaagtgtggaatagtgtagtccgcaaccaccttttcaataccgcgcaggaatcttgttacacatttaaacaaacatatgaactgattgttaactctgaacggttgtcaacggaagaggaatttagagtgggcgctccgcagtttcatacaatacagaggaaccatcgtatgcagttaggagataacgcttatgataaatttctgaagggactggttcagctaagagtatcaggtacgactccagctaagatacgtgatgaggtcgcagcgcttgatgttatcagagataattggatccgtggaagttttgaccgttcacatataaaatcattagaactatgtagattactttcgagtataggtagaaagatggtaaatatggaggaagagccaaaggatgaaaaggatttatcggtcaaattccaattcagattagacgaaaaattctctcccaacgatccagagcgaaacgtaatatttacctctaaaacccaccgaactaatgaggacagattttatgtattattggtaattgcggcgtctgacacgaataacggtcgagtgtggtggtccaacccttacccgtgtttacgaggcgcgttaattgcggcggagtgcaaattgggcgatgtgtatcacaccttaagatcgaagtatgaatggggtgttcgaccaacctacaagccaaaagatctggaacgcgagagagagaagtacgtcgttggacgtgtcaatttgtttgacctcgaaggtgagccggcgacgaaggtcatacattgggagtacgaattaatttcgccgacgtactcagtgagtaaccacaagggaaatcattgtgatttatatccggacgatgtcgaaattacgactaaatttaatgaagatagatatcgtgagatgatccagtcggtaattgatgatgggtgggaccaaaagaatcttaaaatgtataagatccttgaggaagaaggtaatcctttactatatgatcttgaaaaagatattaagctggatagccaatcgcaggttgtgttcccatcatactataataagtggacacatgccccgatgttcaatgctcgggttaaaccatgtgatatagagttggcggagagaaaaaacgatgatccattcgtaaaaagaaccttgaaaccgatcaaagcggattgcgttgacttgttacgataccatatgtctcattactatgatttaagaccatctctcaagggagtgagtttatcgaataagcagacgccctcaggtatccatcaggctctcgtacaagatgatttatattcaaggctattgaggcggcgcgatgtggatttagattatagttcgccatgtcctattataacgaactattttctgttggagaagtttcatattctaatcttgaccatcatggaaaaacattactgggagttagatgatagcgatgatgtatatgagttcccgaaaattgatgcatcggcgttcgaagtggatggtacactgtacgatatctcgcagactatagttcacatgtatgacagattttttgagaagagacgggtgctacgatcgatcgacgaaagtagatggatccttcatctgatcagaatatctcagggtagggaaaggttggaagtgattgagaggttcttcccgaattatgggaaagcaatgcgtcaaagggacttcaagaaagttagagatgtaatgttcttgaattttctacccttcttcttcttgactggtgataacatctcgtatgaacataggcagtggtcgataccaataatattatacgctgacaaattacgaattttaccaattgaagttggtgcgcattacaacaggtttggagtgacatgcatcttggaactactgaacttttttccatcctatgaaaaacgagaggagaagcttgaagaggatattgtgttgtgtgctgatgcgatcgtgaatttttatcttcagacgacgatctcaaatggaggtgtacagacaagtatcgtgtcgactaaggcgctgctttatgagatgtatttatcttccatatgcggcgggtactctgaaggtgttttgtggtatcttccaataacgcatcccgttaagtgcttagtcgctttagaagtatctgatgcattagtcggagcggatgtacgtattgataagattaggcggcgattcccgctatcagctaaacatttaaaaggtatagttcaaatatctgttcacccgaaccgtactttcagcgttacgacctgtgggattgtgaagcataaggtgtgtaaaaagactttgctgaagcatcgatgtgacgttattctattacagacccctggttatgtttttggaaatgatgaactattaacgaagcttctgaacatataaccctgtgacaggggttgggcacgttttcacttac

SEQ ID NO: 82 - DNA, 1637 bp, artificial sequence
  VP5 DNA of BTV3 AJ586697
gttaaaaagatccccatgatcgcgaaagatgggcaaaataatcaagtcgctaagccgttttggcaaaaaagtaggcaacgctttaacctcaaatacagcgaaaaagatttatagtacaatcggaaaggcggcggagcggtttgctgagagtgagatcggatcagccgcaatcgatgggctagttcaaggcagtgtgcactcaattatgacgggagagtcttacggtgaatcggtcaaacaggcagtactgttgaatgtactaggagcaggagatgagattccggacccgttgagtccgggagagcgcggcattcaaatgaagattaaggagatagaggaggagcagaggaatgagttagtgagactgaagcatgggaaagagattgcgaaaaagtttggcgatgagttggaggaaatatatcagtttatgaacggcgaggtgaaagaggaagttcagcaggaggagcaatataaggtgctctgtaaagcggttaactcgtatgagaaattacttctagccgaaaatgacgagatgcgtacgctagcgcgggcactacaacgtgaagccactgaaagaactgagaccgaatccaagatggtgaaagagtataggcaaaagatagatgcattaaaagcggcaatcgaagtggagagagatgggatgcaagaggaggccatccaagagatcgcgggtatgacagctgacgtattggaagcagcttctgaagaagtgccattagtgggttcaggaatggcaacggccatagcaacgggacgagcgattgaaggtgcatataaactcaagaaagtcataaacgcgttaagcggaatagacctttcgcacttgcgaaccccgaagatagaaccaacgatggttgcaaccactttagaacatagattcagagatataccagataaagaattagccgtgagtatcctggcgaagaataacgcgatcgtagcgaatacaagagaggttcaacatattaaggaagaaattctaccgaaattcaagaaaataatggatgaggagaaagaattagaagggatcgatgataagaagatacatccgagagtaatgatgaggttcaaggttccacgaccgcagcagcctcaaattcatatctacagtgcaccatgggactctgacgatgttttcttttttcattgtgtgtcgcattttcatgttaatgagtccttctttctaggttttgatctgggaatcgacgttgttcactttgaggacttagctgctcattggcacgctttgggagccgctcaagaggcgaaagggcgtactctgaatgaagcgtataaggagtttttgaacttatctatcggtagcgcttatacgtcaccaatgcatgcgaggcgtatgattagatcaaagacagtccatccgatctacctaggatccatgcattatgacatcacttacgaaacgttaaaatcgaatgcgcaaaggattgtttatgatgatgaattgcagatgcacatattgagaggacccctacatttccagcgacgcgcgatattgggcgcactcaaattcggagtgaaggtgcttggcgacaagatagatgtgccactctttctaaaaaacgcgtgacagcggtgatcccgggacttacacttac

SEQ ID NO: 83 - DNA, 2926 bp, artificial sequence
  VP2 DNA of BTV4 DQ191280
gttaaaagagtgtcccacaatggaggagtttgtcattcctgtgttttctgagagggagatcccttacgctttgattaatcgatatcctttggcaatccagacggatgttaagattgcggacgtggaaggttatcataatttagcgaagattccagaatcggatatggttgatgtgcctaaactagatatcgttagcgcgcttaactataaaccaacgagaaatgatggtatagtggttccgaggctgttggatattaccctgaaggcttacgatgatagaaagtcggttaagaacgcacgcggcgtggattttatgacggatgctaagtggatgaagtgggcgatcgatgataggatggacattcagccactcaagatcactctagatgaacattacgcagtcaatcaccagctgtttaattgcatagtgaaagcaaaaaccgctaacgctgacactatatattatgactattttcccctcgaagatagagctaagaagtgcaaccatacgaatcttgaactattgagaagtttaacaacgattgaggcgttccacgtacttcaaggcgctgcttatagtctgaaatcaaactacgatctaatcgcgaactcagaaagggaaagcttagaagaaagttatccgataggttcggaaaaatgggtacatctcataagacggaccaaaataggaaacagcggtctatcatataacagattcatctctagcatggtgcaagtggttgttagggggaaagtgccagatataataagaggagagattacacagctcaacaggataaggacggagtggataagcgcgtcatatgatagaactcggattagggcgttggagttatgtaatatattatccgccattggacgtaagatgatggacgcgcatgaggaacctaaggatgaaatggatttatctactagatttcaatttaaattagatgagaagttcaatacatcggactctgaacatgtgaacatatttcggacgagtggggctgccacaaatgagggtagattctatgcgcttatcgcgatagccgcgacggatactcagaaaggccgagtttggcgaacaaatccatacccatgtctgcgtggagcactgatagcatccgaatgtgagttaggagacgtatattataccctacgtcacgtgtatcggtggagcttgcggccggaatacggtcaacgggaacggcaattggaggacaataaatacgtgttcggtcgcgtgaatttattcgattcggatttagctgttggagatcaggttattcactggcgatatgagataaccgaaccagttaaaactacttatgacaacggctacatatgtaatccggaggaaaaagacgatgagctactgtgtaaaatagatgatgagcgatacaaagagatgatggagaggttgatcgaaggtggatgggatcaggagcggtttaaactacataatatcctcacggagccgaatctattgacaatcgattttgagaaggacgcgtacctaaactctcggtcggagctagtgttcccaaactactttgacaaatggataaattctcccatgtttaacgctaggttgaggataactcatggagagattggatcatctaaaacgatcgatccgtggaataggcgcgtagtttatggatatattaaaacatctatagagtcactcgattatacgcttgggaagtactacgacatacggttacaactctttggtgatactttgagtcagaaacaaacccaatcagccgtatttacgtacttaagtggacaggatgacttccctgcattgactaattatttgaagggtgaagcagtgtgcccacacgcgggtggcgcagtatatacattccgtaagatggctttatctctgatagctagttatgagaagctgagtcctgaaatgcacgaaggcttagaacatcagacgtatgtacatccttccgtgaacacagcctaccagaagcaggttaaagacatgaaggatctttctcagttgatctgtttcataatcgattgtattttcgagaagcgtgtacaaatacgcggggttggagaggcaaggcgcatcgtttacctaattcagaactcgacggggttgcaacgtcaagaagtattgaagagaacttttcctaattttctcatgcgtttgttcaaactacgagaagtaaagcgcatctgtgacttaaacgtgatcaactttctgccgttactatttcttgttcaagataatatctcttattggcataggcaatggtcagtacctatgatattgtttgacgacgcagtcaggttgataccggttgaggttggagcttacgcgaatagatttggatttaaaagtttttacaactttattagattccatcccggtgattctaagaagaaacaagatgccgacgacatgcataaagagtacggcgttgcctgcttcgaatattacatgaacacgaagatatcgcagggtggagtgaatgtacctgttgtgacatccaagttggacacgctgaagatacatctagcttctctatgctctgggcttgctgattcgatcgtttacacgttgccggtcgcgcatccgaagaaatgtatcgttctaatcgtcgtaggagatgataagctcgacccgcaggtacgctcggagcaggtattgagtaagtattattattcacgcagacatatatgcggagttgtagctgtaagtgtgggtcaagagggccagttacaggtgtattccaccggtatagtaagacatcgtatatgtgagaaatccatattgaagtataagtgcaaagttgttttggttagaatgcctggacatgtgttcggaaacgacgaactgatgacgaaattactcaacgtttaggtcctttgacacggacctgtggcctcttacacttac

SEQ ID NO: 84 - DNA, 1638 bp, artificial sequence
  VP5 DNA of BTV4 AJ586699
gttaaaaagtgttctcctactcgcagaagatggggaagataattaaatcgctaagtagatttggaaaaaaggttggaaacgcattgtcgtcaaacacagcgaagaaaatttactcaaccattgggaaggctgcggagcggtttgctgaaagcgagatcggtgcggcgacaatagatggcttagtgcagggtagcgttcattccataattacaggtgaatcttatggagagtcagttaaacaggcggttctcctcaacgtgctaggtacaggtgaagaattaccagacccactgagccccggcgagcgtggtatgcagacaaaaataaaagagttagaagacgagcagcgaaatgaacttgttcgattaaagtataataaagagataacaaaggagtttgggaaggagctagaagaagtttacgacttcatgaatggtgaggcgaaggaggaggaagtagttcaggaacaatactcaatgctatgcaaagcagtagattcatatgagaaaatattaaaagcagaggactcgaaaatggcaatattggcgcgcgcgttgcagcgggaggcttcagagagaagtcaagatgaaatcaaaatggtgaaagagtacagacagaagatcgatgcgcttaaagatgcgatcgagattgagcgagatggaatgcaggaggaggcgatccaggagattgccggaatgactgcggacgtcttagaagcggcatcggaggaggtgcccctaattggcgcgggtatggccacagctgtagcgaccggtagagcaatagaaggcgcatataaattgaagaaagtcataaacgcattgagcgggattgatttatcacatatgaggagcccgaagattgagcctactatcatagctacaacattggagcatcgatttaaagagataccagatgagcagcttgcggtaagtgtgctgaataaaaagacagccgtgaccgataactgcaatgaaattgcgcacatcaaacaggaaatattaccaaagtttaagcagattatggatgaagagaaggagattgaaggaatagaagataaagtgattcatccgcgggtgatgatgaggttcaaaattcctagaacgcagcaaccgcaaattcacatttatgcggccccgtgggattctgacgatgtatttttctttcattgcgtttcgcaccatcatcggaatgaatcttttttcctgggattcgatctaggaatcgatgtcgttcactttgaagatttaaccagccattggcacgcgttgggactagcacaagaagcgagcgggcgtacgttaacggaggcgtatcgtgaatttctcaatttatcaatctcaaatacgtatagtagcgctatacatgcgaggcgtatgatcaggtcgcgggcagtacaccctatttttctaggatcgatgcattatgatattacgtatgaagctttaaaaaataatgcgcagagaatagtttatgatgaggaactgcaaatgcatatactaaggggacctttgcacttccagcgtcgagctattttaggggcgctgaaatttggagttaaaatattaggcgataaaattgatgtccccctcttcttacgaaatgcttgaacgcagcgagggagaagcttacacttac

SEQ ID NO: 85 - DNA, 2926 bp, artificial sequence
  VP2 DNA of BTV4 AJ585125
gttaaaagagtgtcccacaatggaggagtttgtcattcctgtgttttctgagagggagatcccttacgctctgattaatcgataccctttggcaatccagacggatgttaagattgtggacgtagatggttatcataatctagcgaaaattccggaatcggacatggttgatgttcccaaactagacatcgttagcgcgcttaactataaaccaacgaggaatgatggtatagtggtaccgaggctgttggatatcaccctaaaggcttacgatgacagaaagtcggttaagaacgcacgcggcgtggattttatgacggatgctaagtggatgaagtgggcgatcgatgataggatggacattcagccactcaagatcaccctagatgaacactacgcagtcaatcaccagctgtttaattgtatagtgaaggcgaaaactgctaacgctgataccatatattatgactattttcccctcgaagatagagctaaaaagtgcaaccatacaaatcttgaactattgcgaagtttgacaacaattgaagcgttccacgtacttcaaggcgctgcttatagtctgaaatcaaactatgatctaatcgcgaactcggagagggaaagcttagaggaaagttatccgataggttcggagaaatgggtacacctcacaagacgggccaaaataggaaatagcggtctatcatataacagattcatctctagtatggtgcaagtggttgttagagggaaagtgccagatataataaggggggaaattacgcagcttaacaggataaggacagaatggataaacgcgtcatatgatagaactcggattagggcgttggagttgtgtaatatattatccgctattggacgtaagatgatggacgcgcatgaggaaccgaaggacgaaatggatttatctactagatttcaatttaaattggatgagaagttcaatacatcggattctgaacatgtgaacatatttcggacgagtggggctgccacaaatgagggtagattttatgcgcttatcgcaatagctgcgacggatactcagaaaggtcgagtttggcgaacaaatccatacccatgtctgcgtggagcgctgatagcatccgaatgtgagttaggagacgtatattatactctgcgtcacgtgtatcgatggagcctgcgacctgaatacggtcagcgggaacgacaattagaagacaataaatatgtgttcggtcgcgtgaatttattcgattcagatttagctgttggagatcaggttattcactggcgatatgagataaccgaaccagtcaaaactacttatgataacggctacatatgcaatccagaggaaaaggacgatgagctactgtgtaagatagatgatgagcgctataaggaaatgatggagaggttgatcgaaggtggatgggatcaggagcggtttaaactccataatatcctcacggagccaaatctgctgacaatcgattttgagaaagacgcgtacctaaattctcggtcggaactagtgttcccaaactactttgataaatggataaattctcccatgtttaacgccaggttgaggataactcatggagaaattgggtcgtctaaaacggccgatccgtggaataggcgcgtagtttatgggtatatcaaaacatctatagagtcacttgattatacacttgggaagtactacgacatacggttacagctctttggtgatactttgagtcggaaacaaactcaatcagccgtattcacgtacttaagcggacaggatgatttccctacattgactaattatttgaagagtgaagcagtgtgcccacacgcggggggcgcggtatataccttccgtaagatggctttatctctgatagctaattatgagaaactgaatcctgaaatgcacgaaggcttagaacatcaaacgtatgtacatccttccgtgaacacaacctaccaaaagcaggttaaagatatgaaggatttctctcaattgatctgctttataatcgattgtattttcgagaagcgtatacaaatacgcggggtcggagaagctaggcgcatcatttacctaattcagaactcgataggattacaacgtcaagaagtgttgaagagaacctttcctaactttctcatgcgtttattcaaactacgagaagtaaagcgcatctgtgacttgagtgtgatcaactttctgccgttactatttcttgttcaagataatatttcttattggcataggcagtggtcggtccccatgatattgtttgacgacgcggtcaggttgataccggttgaggttggggcttacgcgaatagatttggatttaaaagcttttacaactttattagattccatcccggtgattctaaaaagaaacaagatgccgatgacatgcataaagagtacggcgtcgcctgcttcgaatattatatgaacacgaagatatcgcagggtggagtgaatgtacctgttgtgacgtccaagttggacacgttgaagatacatctagcttctctatgcttagggctcgctgattcaatcgtttacacgctgccggttgcacatccgaaaaaatgtatcgttctaatcgtcgttggagatgataagctcgacccgcaggtacgctcggagcaggtattaagcaagtactattattcacgcagacatatttgcggagttgtagctgtaagtgtaggtcaagagggccagttacaggtgtattcctccggtatagtaagacatcgtatatgtgagaaatctatattgaagtataaatgcaaagttgttttggttagaatgcctggacatgtgttcggaaacgacgaactgatgacgaaattactcaacgtttaggtcccttgacacggacctgtggcctcttacacttac

SEQ ID NO: 86 - DNA, 1638 bp, artificial sequence; identical to SEQ ID NO: 84
  VP5 DNA of BTV4 AJ586699

SEQ ID NO: 87 - DNA, 2921 bp, artificial sequence
  VP2 DNA of BTV5 AJ585126
gttaaaagcttctcaggatggatgagttcggtgttccgatatttcggtcgagccaagttccccaccacatactcgaaggatatgatattaaggtcgacttgagtgatagggtggtgcaagaggatggtcgtcatgatccaaataagttaaaagaacgaaaaacgatagatgtaccaaatggtgaagccagatctgatctgaattacaacccaacggataatgaaggcaaccagctaccacgtgcgctagacattgcattatgtgcgcggcttacgaggaaaagtttcaacacaaacagtggtgttacgtttcatacggatcacaaatggatggaatggatgctgtccgatgcaatggatgttcaaccactgcgaatcgacttagcagcgcagaacgagtacgcaaaatgtgacctatttaattcatcggtctatgtcaggaaaaaatatgttgatgcaatctcatatagatatatatcagtggaagatgattctaaggggtgcaatcatacgagggtttatagcgtgaatcatatgataaattgtggattgtataacgtggcgcaagagtgtgcgtacgcgtttaagcatacgaatacgttaatagttaactcacaaagagaaaccactagtgagccgttccagcccggaaacccaaagattggaagcttggggagaagggcaagggttgacatggctgatcctgggtatccgcttttccgcgcaggattacttcaaataattgttaatggcgctataccggccgatatacgtagcgagatggatcgcttgaatcaaatacgcgaggcgtggaaacgtgataaaaatacaagagaggtcagagcgctcgacttatgcgtactgctatcaaagattggtcgaattaagatgaatatggaagaagaacctaaggatgagggagtcatgtcgttaaggtttcaggggaagattgacgcgatgtttttctcggaaaatacggagaaaacaaatattatgcgagatggtagtggtagaactgatgatgagagattttacgccttattgctgatctgcgctacggacgcgttctcacgacgtatatggcgcactaacccgtatccgtgtttgcgaggcactctaatcgcagcagagtgtgtattgggagatccatataaaacgttacgccgtaagtttgactggagtgtgcgccatgcaggagataagatgctggaagggtcctcgtatgtttttacaaggataaacttattcgatacggataaggcgccaggttcacgtgtaatacactggatacaggagacacttcctgtcataaaaacaacctgggctgagggatgttctttagctgatgaagcgtcagatgatcatctacattgcaaaatagatcacgcacaatatagagatctagtatcaagagttataaatggagggtgggatcaagagaactttaagatacataaattattcgttgaacgaggcaatattttcttaatggattttgaaaaggacgcaaagattactacacagtctgaggtggagtatccatactattatgatacatggatctatgcgccgatctttagcacgaggtataagataacggaaactgaaatcgccaacgcaaaaagcttggaccctgcgattaagcggacgcttgccccattgtctgatgatcccgtagcgttacaactgagagctgtaggacatctgtatgatactcgccctgctataatgggtcaaacactgtcaccacgccagaatcagactgcactacacaagacgttattagatgatcctgaaaatgatagatactatgaagcacgatcgatcaaaaaagtcgataatccttgctccgttcattacacgtcatcattcatattacagaagatctctgagttggtcttaagtttgatgatttatcacattgaacatgactgggagccactgaagcaatacacgcatccggaaatctcaacggagttcggcgaaatatcgtgtgagatatgtgatatctctcagctaaccgtcttattaattgacttattctttgaaaatagacgaacggtacgtccaagtgaggagacgagatatataattcatcagatccgagaatcgagaggtgatggcagacttaagatgctagaacgattcttccctgcctatgggcaagctcttcgcaaaatcgagagcgctactgaagtgggacatataactatgttgaattttttgccttttttctttttattgggagataacattatatataaacatagggagtggactgttccaatcctaatatacactgatggcgtcatgatttggcccgcgcaggtaggcgctaattataatagatttggtttctgcggttttcttaattatatgaggttccatgctggaagccaactgagatctaaagtactcgatgatgctgagaaaaccattgcaaaagaaatgcttaagtactatatgaaaaccgacatttttagtggaggcgttcaaaagaatatacgtgtcacgaaatcaatgcaaatggaaatataccactcatcgctgtgtggaggattatcagacgcagtggtatatgcattgccaattagcttcccgatcaaatgtttgactttgattattattggtgatgatctcgttgaaccgcaactcagaatctcgagagttatggattattttaagcatgtgagcgagcacgtccgaggcgttgcatcgatctcaatttcgagaaatggagatgtttctacctattctcgcggtattgtgcatgtcgagttgttgaagaaaaatatattaaaataccaatttcaagtcgctttactaaaagttaaaggatacgtgtttggcaatgatgaaatgctcattaaattattgaacgtttagtctcagtgacatgagactcctggagcatacacttac

SEQ ID NO: 88 - DNA, 1637 bp, artificial sequence
  VP5 DNA of BTV5 AJ586700
gttaaaaagatccctatgatcgcggaagatgggcaaaatcataaagtcattgagccgctttggcaaaaaggtggggaatgcgttgacatcgaatacagcaaagaaaatctatagtacaatcgggaaggcagcggagcggtttgcagaaagtgagattggatcagcggcaatcgacggattagttcagggtagcgtacactcgatcatgacgggagaatcatacggtgaatcagttaaacaggcggtactgctaaacgtgttaggtgcaggagatgaaattccagacccactaagtcctggcgagcgtgggattcaaatgaaaattaaagaaatcgaagaagaacagagaaatgagttagtgagattaaagcatgggaaagaaataacaagaaagttcggtgcagagttagaggagatttaccaatttatgaatggcgaaatgcgagaagaggcggagcaggaggaacagtataaggtgttgtgcaaagctgtcaattcatacgaaaaattactcgtcgcggagaatgatcagatgcgcgcgttagcacgagcgttacagcgtgaagcgactgaaagaacagaagcggaatctacgatggtaaaggaatatagacaaaagatcgatgcattaaaagcggctattgaagtcgagagagacgggatgcaggaggaggcgatccaagagatagcaggaatgaccgcggatgtacttgaagccgcgtctgaggaagtaccgttagttggttctgggatggcgacggccatagcgacaggtagagcaatagagggagcgtataaactaaaaaaggtaataaacgcgttgagtgggattgatctgtcgcacttgcgcacgccgaaaattgaaccgaccatggttgcgactacattagagcacagatttgatgagatacccgataaagaattggcggtgagcatattagccaaaaataacgcgattgttgcgaatacaagagaagtgcaacacataaaggacgaaatattaccaaaatttaagaagattatggatgaggagaaagagcttgaaggcattgatgataaaaagattcacccgagggtgatgatgagattcaaggtgcctcgctcccagcagcctcagatacatatatatagcgcaccgtgggattcagacgatgtcttcttctttcactgtgtgtcccactttcacgcaaacgagtcattctttttgggatttgatctgggcatcgatgtcgtacattttgaagatttggccgctcactggcatgcgctaggtgcggcgcaagaggcgaaggggcgtacgctcagtgaggcttatcgtgagtttttgaatttatctattggtagcgcgtacacatccccgatgcacgctcgacgcatgattaggtcgaaaacagtacatcctatatatctcggttcgatgcactatgacataacgtatgaaactttgaaatcaaacgcgcagaggatcgtatatgatgacgaattgcaaatgcatatcttgagaggtccgttacactttcaaaggcgcgcgattttaggtgcacttaaatttggggttaaggttctcggtgacaagattgatgtgccactcttcctcagaaacgcgtgactgcggtgatcccgggacttccacttac

SEQ ID NO: 89 - DNA, 2922 bp, artificial sequence
  VP2 DNA of BTV6 AJ585127
gttaaattagtttcgtgatggatgagcttgcgattccgattattaatgggcatttccccaaagaagcactaattgagtatgactgcatagtagaattgaatgcgccgagcgaagatgatgaggtcgatgtaacccaaattcccacgaagaacatgatggatataccggatgttccgattcgtgaagcgctaagggttttacctcaaaggaatgatggtcacgtgctaacacggatactggatatatcgttaagcggatatgataggaggaaatattataagacaaataaaggcggtgagtttgaatcgccgaaggagtggctaaattggatgatccacgactcaatggacgtgcaacctttaaaggttagtttggaaatgagaccaacagttaaacatgaattgttcagctcaaacgtatatctatcagtgaagaaggcagatacatcttcatatcacatcgaggcgattggtgacacaggtaaggcgtgcgatcattcgtacgtatctatgtggaataacttagtgaggcacgaagtaatgcactgcgcacaggagagtgcctatgtcctgaaaccaactatggagataattgtacactctgagagagcctcgactgacgtaccgtttcagctggttggacagaattacgtttcgatcgggagaaatcatcgattggtattaggagatgagccatataagaagacattacagggattgacgaaattgcgtgtgcagggcaaagtgccacctcagatacaggatgaaattcagcagctaaataggatacgtgatgcgtggattggtgatgcgtacaatccgaggcatattcgctcgctggaactatgtcggattctgtcaagtgtcggaaggaaggtggtatgtatagaggaagagccgaagaacgaaagtgatatatcggtcaaattccaatttaaactagatgaaaaattcagattaaatgatggcgagcggggagtgatatttacgtcgaaaaaccaaaggaatgatcaggatcggttctttgtactaattatgatagccgcctctgacacctataatggcagaatatggtggacaaatccgtacccttgcttgcgtggagcattgatcgcatcagaaacgaggttgggcgatgtttactggactctaagacacacttacgattggagcgttagaatgacatactcgccgaggatgaaagaacgtgaagatgacaagtacatatatggacgcgtgaatttattcgatctagatgcatcacctggtgataaagtcgttcattggaggtatgagttgatctcacagacgaagaagactacgtttcatgatggtaatccttgtgacttatttccggatgtagaaggaattgtgactaaatttaacaagaccgcatattcaaacatgatcaacgaattactaaatggggggtggaacacacgcgaatttaagatgtacaaattgttggaagatgagggaaacgttttgacaatagatcttgagaaagatacgaagcttaattcgagatcggagtttattctacccaattattatgataagtggatatatgctccaatgtttaacgcaaaattgaagattacggagaccgagatagcgcaggcaaagaatgacgatccatacgtcataagaacgcttgcacccataggctcaaacccattcactctacaacggttgtgccttggaaattactatgatgtacgacctgctatgcatggacgcgcgctctctaagaaacaggaacagtcggcttatcacgcggctctcgtgaaagagaaggattacgaagacatactgacacgccggggtttgcgtaaagctgacaagccgtgtccattaaccacgtgtgcttatattctcgagaagacagctctattgtggattgatgtgatggagaagcacattagcgaagtcactgatgattcaaacgaattcgattttccaaaagcgtgcgtggattcaccagttgggactgataggattgtcgatgtcacacagttgatcgtacttcttatagactggatttatgagagacgtaaagatgttcgtagtgtggatgaatcaaggtgggtcatagaaacgattagacgtgctagaggtagaaatagattagaattaatatcacgtgagtttcctaactttggaagagcagttgcacgcctacaatcaccaaatactgtaggtgatgttatggtaatcaactttttacccttcttattcttgatgggagataacgtctcgtatgaacataggcaatggtctgtcccggtcattctgcacgccgacgttatgtggtttattccggttgaagttggggctttctacaatcgcttcggcgtgacgtcattcctagaatatttgatgttctttccctctttccacatgaggaccgttcgactagatgaggctgaagtgaaggtaagcaagttaattttagacttctatcttgatacgacaatattctctggtggcatacagagtagcgtggtctcgactaagcagatcttgtatgaaacatacttgtcttcattatgtggtgggttctcggagggattagtttggtatcttccaatcacgcatcctacaaagtgtgtagttgcgatcgagttcgcggacaataaagttagcgcggtttataggtgcaatagattacgcgcgaggttccctttgagttctatacacttaaggggcattgcgatccttacgatcgggaagaatagaatggttgacgcttacacagaggggatcgtctctcatcgtatatgtaagaagaacgtattaggatatacatgtcagattctattgctgaaattttcaggccacgtttttggaaatgacgaaatgctgacgaagctgctcaatgtttaacctcagtgacatggggttcacgaactaatcaacttac

SEQ ID NO: 90 - DNA, 1637 bp, artificial sequence
  VP5 DNA of BTV6 AJ586703
gttaaaaagatccccatgatcgcgaaagatgggcaaaataatcaaatcgctaagccgttttggcaaaaaagtgggcaatgctttaacctcaaatacggcgaaaaagatttatagtacaattggaaaggcggcggagcggtttgctgagagtgagatcggatcagccgcgatcgatgggctagttcaaggcagtgtgcactcaattatgacgggagagtcttacggtgaatcggtcaaacaggcagtactgttgaatgtactaggagcaggggatgagattccagacccgttgagtccgggtgagcgcggcattcaaatgaagattaaggagatagaggaagagcagaggaacgagttagtgagactgaagcatgggaaagagatcgcgaagaaatttggcgatgagttggaggaaatatatcagtttatgaacggcgaggtgaaagaggaagttcagcaggaggagcaatataaggtgctctgtaaagcggttaactcgtatgaaaaattgcttctagccgaaaatgacgagatgcgtacgctagcgcgggcgctacaacgtgaagccactgaaagaactgagaccgaatccaagatggtgaaagagtataggcaaaagatagatgcattaaaagcggcaatcgaagtggagagggatgggatgcaagaggaagccatccaggagatcgcgggtatgacagctgacgtattggaagcagcttctgaagaggtaccgttagtgggttcaggaatggcgacggccatagcaacgggacgagcgattgaaggtgcatataaactcaagaaagtcataaatgcgttaagcggaatagatctttcgcacttacgaaccccgaagatagagccgacgatggttgcaaccactttagaacatagattcagagatataccagataaagaattagctgtaagtatcctggcaaagaataatgcgatcgtagcgaatacaagagaggttcaacatattaaggaagaaattctaccgaaattcaagaaaataatggatgaggagaaagaattagaagggatcgatgataagaagatacatccgagagtaatgatgaagttcaaggttccacgatcgcaacagcctcaaattcacatttacagtgcaccatgggactctgatgatgttttcttttttcattgcgtgtcgcattttcatgttaatgagtctttctttctaggttttgatctgggaatcgatgttgttcactttgaggacttagctgctcattggcacgctttgggagccgctcaagaggcgaaaggacgtactttgaatgaagcgtacaaggaatttttgaacttatctatcggcagcgcttatacgtcaccaatgcatgcgaggcgtatgattagatcaaaaacagttcacccgatctacctaggatccatgcattatgacatcacttatgagacgttgaaatcgaatgcgcaaaggattgtttatgatgatgaattgcagatgcacatattgagaggacccctacatttccagcgacgcgcaatattgggcgcgctcaaattcggagtgaaagtgcttggcgacaagatagatgtgccactctttctaaaaaacgcgtgacagcggtgatcccgggacttacacttac

SEQ ID NO: 91 - DNA, 2936 bp, artificial sequence
  VP2 DNA of BTV7 AJ585128
gttaaaaaggacctcgccagaatggatgaattcgcaattccaatcgtgcatggcagagtgattccgtatgatttggtgcgttcgtatgacattgtagtggatttagatgtgagaatagatgaggaaggagacaaacatgatacgaccaagataccagaagcatatatgtgtgatgtaccgaatatagcgatgcaggatgctaattcagcaatattggggaggaatgatggttacgctttgccccgcattttagatgtatccatagcggcatatgatcctaggaagggatattggaaatatagaggtatagagaagatgactaatcaaacctggttgaagtgggctatcaaggattttatggatgtgcagccactgaaggtggatctggctgatcttgaaggtaaagtgaggtatgatatgtttaattgttctgctcgaatagatgctaaaaaagccgaggcgatttattatggttgggcagctcaggaggtagtgaacaaaggttgtaaccatgcgaaaagcgagatgtttcagcatgtcgtaagatgcgagctgttgaattgttcgcaggaaagcgcgtacattttaaagccgactcaaaagatagaacctctcgctgaaaagaatgatctgggtgagaggctcgggccaggctctaataacttaattaatatgcgacgtggggatacatttaggatggggacagaccagtacaaccgcatgttgcagggatggtaccgggtgaaggtgaaaggtcaaattccggatatggttagagaagagatggctgagctagtaaagataagggatagatggaaagttgcgaaaaatccgagagagattaaatcccttgaattatgtaaattgctctccacgataggtaggagaatgtataatatgtacgaggaacccaaagatgaggaagcggtttcgttaagatttcagtggaatttggatgagattttcaaaactgataatagggagcacgttaacattgctgtcaacaagaatgggagaacagatgatgagcgattcttcgcacttatcatgatagccgcaaccgatacgaatcgcggaaggatttggtggtcgaatatgtttccgtgcctacgaggcgctttaattgcgagcgaaactcaattcggcgatgtatataagatgctaagggtgcgattcgaatggagtgtgcggaatgaatatagccctcaggctgacgtcgcaagacagaatgagaactacgtgtacgcacgcgtcaatctatttgatctagtcgctgatccggcgacatctgtgatccattgggaatataaattggataagccctttaagacttgctactcagacggtcatcaatgtgatgaatatcctgatgaatatgatttaatttgctcctttgatgaagctaaatacagcgaaatggtccaacgcattatagagggtggatgggatcataaaaactttaaacattacaagatattgaaagaagcttcaaatgtgctcacgatcgactttgagaaagatgcgaagttgaatgagagctcggagatgaacctgccttattattttaacaaggacatcgcggcgccaatgtttagatgtgtgttgaaagtatgtgagacgtcaatctcagagcgccacaatctagacccggcaatatcgcgtacgatgaaacccatgagggctaaagctgcggacctattagactactctctgggttcctactatgagacccgatctggcgtgatgggcaggacgttaacaacaacgcagaagcagagtgatatgtataagatggttcaagacgaagatgattacttatcattgatggtaggacgaggcgtcaccgacaaatttgcgaacccatgccctattacaactgctggccagtacgctctacaaaagacatcagttatgatcttttcacgggttgaacattattttgaagagtatctcaaagatgacaaggtagagtatttgagcccgtctctaaaccttgaatgggttgaaataacatcaaggataacggatatctcgcagttgatagtactgacgtttgatgtattttttgaagggcgtagacaggtgcgtactattgatgagtcacggtttattctctatcagataagggcgcgtaaaggtatggatcggctttcatatattaaagatctattccctcaattatatgggtggtgggtgtctccagagcccacatatggccacgctcagaaattaaatcttctacccttgttattcataattggtgataactttatttatgagcatcgccagtggtcatacccggtgattttagtgtcacacaaactgagattcgtacccgttgagttgggggcttattacaacagatttgggcttacgtctttattctcttacttggttttccacgtagggaagtcaaaatatgggttggaacttgatgaagcagagaaaaaggtgctgcaggctgcgaaagactattatgctgtggcgactatttcagagggagggattaatacgcattcaactatgaccaaagatccgatttatcaagtttatctatcaacgatatgtggcgggttactcgattcgcttatctatctgatgccgattacccaccctgtcaagagtatcatcatggtaatcataaatgatgggagggggtcggcctcggactgcgtacggcgtgcgacacgtcgattgagatatattcaacgtcatatacgcggctcggttgtcgtctcggtcttgcgggatggcgtgattaatacatattcagaggggatcgccaaagccatgttgtgcgagaaaagtgttttgaagtacaattataaggttgtgctggttaaggtgaaaggatatgtgtttggccatgacgaaatgctaactaaactgctgaatgtataatccctttgacaggggattggcggccttaaacttac

SEQ ID NO: 92 - DNA, 1637 bp, artificial sequence
  VP5 DNA of BTV 7 AJ586704
gttaaaaagtgtcctcatcatcgcagagatgggcaagatcattaaatcattaagtagattcggaaagaaagtggggaacgttctgacgtcaaatacggcgaaaaagatttatagtacgattgggagggcggctgaacgtttcgccgagagtgaggtgggtgcagccacgatagatggaattgttcagggaagcgttcactcgatcatgacgggcgagtcctatggtgaatcggtaaaacaggcagtactgcttaatgtgctaggcagtggtgaagaattacctgaccccctaagtccaggagaacgcggaatacagaccaaactaaaagagttggaggatgagcaacgcaatgagctggtccgtttgaaattgaataagaaaatagtcgacaaattcggaacagaattggaggaggtttatgattttatgaatggggcggcgaaagatgatgagaatgaaattaaacaatacgatattttgtgtaaagctgtagactcatacggaaagatcttgcgagaggaagacaagaaaatgttggaattagcgagagcgttgcagcgtgagtcggagtcgagaagtgacgaggagaccaagatggtgcgggaatatcgttcgaaaatcgatgcgttacgcgatgcggttgacgttgaacgtgaaagcatgaccgaggaagcgatacaagagatagcaggaatgacgtcagatgtcctagaggcggcggcggaggaagttcccttggttgggtcgggaatggcgacggcaatagcaacgggacgcgcgattgaaggcgcgtataaattgaagaaggtaataaacgcgctaagcggcatcgacttgactcatttacgcacgcctaagatagagcccagcttaattgctacaacattagagtatagagataggccaattccagatgattcactagcagtcagcgtacttgagaagaggagggcgatagaagaaaataaaaatgagatcgaacatattaaaaatgagattttaccccggtttaaaaaagcgatggaggaagagaaggagatttctggaatcgaggagtctgtgatacaccctaaagtaatgatgagattcaagatccccagatctcagcagccccagattcacatttattgttcaccgtgggattcagacactgttttcttttttcattgtgtatcacatcatcatatgaacgagtccttttttatcggtttcgacttagagctagatttagtgcattttgaagatttgaccgcgcattggcatgctttaggcgccgcgcaaatggttgttggacgcacgttccaagaggcgtatcgagagtttttaggtcgtgcgatgatggatccctcgagcggagcgatgcataagagaagaatgtcacgatcccgtagtgtgcatcccatttatcttggatcgatgcactatgatatatcctacgctaccttgaagagtaacgcacagcggatagtttatgatgatgagttgcagatgcacgtgctgcgtgggccgatacattttcagcgcagggcaatcttaggtgcacttaaacatggcattaaaatacttaatgataaaattgatctcacatctcttcttagaaatgcgtgaagcagcgatgacaggcgcttacacttac

SEQ ID NO: 93 - DNA, 2939 bp, artificial sequence
  VP2 DNA of BTV8  AM498052
gttaaaatagcgtcgcgatggaggagctagcgattccgatttatacgaatgtattcccagcggagcttttagatggatatgattacatcattgatgttagtagtcgtgttgaagaggaaggtgatgagcccgttaagcgacacgatgtaacagagattcctaggaattcaatgttcgatattaaggatgaacatatacgtgatgcgattatatacaaaccagtcaacaatgatgggtacgtactaccgagagtattagatatcacgctgaaagcctttgacgaccggaaaagagttgttttgaatgatggtcatagcgaatttcatacgaaaacgaattgggttcagtggatgattgatgacgcaatggatgtccaacctcttaaggtagatatcgctcacacgcgctcgaggatcagccacgcactctttaactgtacggtgcgattgcattcaaaaaaggctgacaccgcatcttatcacgttgaaccagttgaaattgaatcgtggggatgtaaccacacatggttgagtaggattcatcatctagtgaatgttgaattatttcattgttcacaagaggcggcgtatacattgaaacccacatataagataatatcaaatgcggaacgtgcatcaacgagtgattcctttaatggaactatgatcgaattaggtcgtaatcatcaaattcagatgggtgaccagggataccagaagttgaaagaagggttggtacaagttcgaattgaagggaagacgcctttggtaatacaagaggaaataaccgctttgaataaaataagagaacaatggatcgctcgaaatttcgatcaaagggaaatcaaggttttagatctgtgtaggttgttgtctacgataggtaggaagatgtgcaatactgaagaggaacctaagaatgaagctgatctttcagtgaagttccaaatggagcttgacgaaatatttcgaccgggaaataacgagcgtaccaacatcatggggggcggagtacatcggaaaaacgaggacagattttacgtactaattatgatcgctgcatccgataccaataaaggtcgtatatggtggagcaatccgtatccctgcctgcgtggagcgttaatcgccgctgaagtccaattgggtgatgtttacaatcttttaaggaattggttccaatggagcgtacgacctacctatgtaccttacgataggaatagagaaagtgataagtatatttatagtagaatcaatttatttgattcaaccctgagaccaggcgacaaaatagtacattgggagtataagttgcttaatgaagtacgagaggttagcatcaacaaaggtaatgagtgcgatctgttccctgaggatgaagaatttaccaccaagtttcatgaggcgcggtatacggagatgaagaaccaaattattcaaagcgggtggaatcaacgagattttaaaatgcataaaatactagaggatggcgcaaatgtgttaacgattgattttgagaaggacgcgcacatcggcacgggttcggccctgagtttgccggattactataacaaatggataattgctccgatgtttaacgctaagttacgcattaccgaggttgtgattggaacggctcacaccgacgatccagctgtagggcgcagcgcgaaggcgttcacacatgatccttttgacctgcagcgatattgtctagcaagatactatgatgtacgacctggtatgatgggccgcgctctctctaagcaacaaaatatgtcgtcgatgactgataaactctctaagcaggaggattacgcagggattgtttcaaggcgtctggaatacaaggaacgagagaacagatgcttgacggagacagcgcagtatgtattcgagaaaacatgcttatacgtactagaattattgagcagacatacgatgccctcggaggattctgaagtaacgtttgaacacccaacaattgatcccagcgtcgatattgaaacgtggaaaataattgatgtttcgcaactgatcatattcgtatttgactatttgtttgaaaatcggaagatcgtgagggatactaccgaggcaaggtggacgcttttcaaaataagatcggaagtaggacgagccaggattgacgcaatagagatgacttttcctcggtttggacgtatgctaagaaatgcgtctcaggcaaagataaatcaagatatcgcgtgcttgaacttccttccactacttttcatcataggcgataatatatcttacgcacatagacagtggagtataccggtgctgctgtatgcgcacgatatccgaattatacctttggaagttggagcgtacaataatcgttttgggctgacgtcatacctagagtatatggctttctttccatcgtacgctactagagtagctaaaattgacgagtcgatcaaggagtgcgcgatcgcaatggctgagttttatatgaacaccgatatccacagtgggagtgtgatgagtaacgtgataacgaccaagcggctattgtatgaaacatacttagcttcgctatgcggcggttattcggatggattgctttggtacctgccaattacacatccctcgaaatgcttagtcgcctttgaggtagctgatgacgtagttccactctcagtaaggcgggaacgtattctatctaggtttcctttaagctcgagacatgtcaaggggattgcgttgatttcggtggataggaatcaaaaggtatcggttcaaacagagggtattgtaacacatcgtctctgtaaaaagaatctgttaaaatacgtgtgtgatgttattctttttaagttttctggacacgtttttgggaatgatgagatgttaactaagctgctcaatgtatagctctcgtgactgagagctcgcgcgctatcaacttac

SEQ ID NO: 94 - DNA, 1637 bp, artificial sequence; identical to SEQ ID NO: 74
  VP5 DNA of BTV8 AM498056

SEQ ID NO: 95 - DNA, 2921 bp, artificial sequence
  VP2 DNA of BTV9 JN255903
gttaaaagttatctaggatggatgaattcggaatacccatttatctttcgagtagcgtaccacacgacttactcagcgattacgattttatgattgatctgagtgataaagtagtgcacgccggagaccgacatgatccgaaaaaattgaaagagaggaaagcaatagatgtgcctgatggtgaagcgcgtacagacttaaattataatccaacagataatgaaggtaatcaactaccacgagcgctagatatcgcattaagtgcgcgtcttacgagaaagagcgtgcgaaataatgatggcttggactttcttaccgatgataaatggatggagtggatgctatctgacgctatggatgttcagccactaaaaattgatttgagtgcgcgaaatggatttgttaagtgcgacattttcaactcatctatatatataaggagaaaatacgctgatgcgatcgcgtatcgatatacgtcattggaagatgaatcaaagggttgcaaccatacgagagtgtgtatggttaaccatctgataaataatgggttatataacgctgtgcaagagtgtgcttacgctttaaaggatacgtacgttctacgagtgcattcacagagggaaaggatcgatgaaccattcgagccaggtaggccgaagataggtagtttggggaggaatgcgagaatagatatgagcgatccggggtattcgctttttaaaggtgggatgttacagattacggtaagtggtgagataccgaatgacatacgcgttgagatggaacggctaaaccaaatccgtgccacttggatacgtgataagtcttcaagggaggtgagggccatagagttgtgcacactattatcaaggattgggcgtgtaaaatggaatgcagaggaagaacccaaggatgaaggtgctatgtcattgagatttcagaacaaaatagattcaatgttcctctccgagaatacagagaaaaccaatatcatgcaaaacacgagtggtcgcacagatgaggaaaggttttatgccttgttgctgatatgtgcaacggatgcgtactcacgtcgtatatggaggtccaatccatatccctgtctacggggcacgttgattgcagcggaatgtgtcttaggtgacccgtataaaactttgcgacggaaatttaattggagtgtacgccatgcggcagacaaagcgctagagaataacgcgtatatctttacaagaataaacctgtttgatacagaaagaacaccaggcatgcgggttgtacattggacgcaggagctaactatggagtcgcagacgacttgggacgaaggatatccattgaaagatgaagcgcccgatgatgagatgcactgtaagattgatacaaacaaatataaagaaatggtgacgcaggtgattgatggtggatgggaccaggagaatttcaaaatccataaactctttcacgacgatgggaatatatttctgatggatttcgaaaaagatgcgaagttgaccgcacagtcggaggtgcaatatcctgactactatgataagtggatttatgccccaatctttgacactaagtacaaaatcacggagacggagatagcgaatgctaaaaatctagacccggcaatcaagcgcacgatagatcctatgatggatgaccctgtcatgttgcaattgagtactatagggaatctgtatgataccaggccagcggtgatgggatcaaccctatcaatgagacaacgccagacatcgcttcataaaacgctattggatgatcctcaaaatgaacgtttctattcatctagatcaatcaagaaagttgacgacccttgcccggtttattatactgcatctttagtgttgcagaaaatctctgaacttgtaatgagcttgatgatctaccatgtggaccaggattgggagtcacttaaacagtataaacatcctagtattctgtccgacttttcttcgctcgtgtcaaatatccaggacatctcacaattggttgtcctcttagttgatttcttctttgaacgaaggagcgtgttaagatcggttgaggagtcaagatacatcatacacatcattcgctcgtcaaacgatgcgaatagattgaagagttttgaattatattttccacgatttggagggatattacgaacgatcaaagatgctaaagaggtttctcacgttaccgctttaaactttttaccttattttttcttgctgggagataatataatatataagcataaggagtggtcggttcccgtgctaatatattcagatggcctcatgatatggcctgcgcaggttggagctaactttaatcgatttggcttttttggattcttgaattatatgagatttcatcccgggattagattgagatctaaagtgctcgatgatgcggaaaaagttgtagcggttgaaatgctgaattactatatgcgtaccgatatattcaaaggaggtattcagaagaacgtacgagttacgaaactgtcgcaaatggaaatctatcattcatcattatgtggcggtctatcggatgctttaatctatgcattgccaatcagttttcccatcaaatgtcttactttaatcattgtcggcgatgatttagctgagcctcaacataggatcagcaaggccttggaattttttgagcatgtccgcgaccacgtgcggggaatcgcgtcaatatctatatctaggaatggagatgtaacgacgcattcgcagggtattgttaaagttgagctgttaaaaaagaatatcttaaggcatcagttccgagttgctttattgaaggtgaaaggatatgtatttggtaacgacgaaatgttgactaaacttctgaatgtatagtcccagtgacatgggactcctagagcttacactcac

SEQ ID NO: 96 - DNA, 1635 bp, artificial sequence
  VP5 DNA of BTV9 AJ586708
gttaaaaagcgtacccttagcgaagatgggtaaagtcatacgatccctaagtcggtttggtaagaaagttggaaatgcgctaacgtcgaatacagcaaaaaagatttacagcacgattggaaaggcggctgaacggtttgcagaaagtgaaatcgggtccgcagcgatagatggcttagtgcaagggagcgttcattcaataataactggtgaatcatatggggagtcagtaaagcaagcggtgttattaaatgttttaggaagtggtgaggaaattcctgacccattgagcccaggcgaacgtggaattcaaacgaagttaagagaattagaggatgagcagagaaacgagttggttcgtcttaaatataatgatgaaattaaaaggaaatttggggaagagttagaacaagtttacgactttatgaatggggttgcgaaggacgaggagggcgaagagaaacagtttgatatattgaacaaggcagtgaactcatatgacaaaatcctagcggaggaagatacgcaaatgaggcgtttggcgacagctctacagaaagagattggagatagaacgcacacggagacgacgatggtgaaggaatatagaagtaagatcgaggctttgaagaacgcgattgaagttgagcgagatgggatgcaagaagaagcaatacaggagattgcgggtatgaccgctgatgtgttagaggctgcttcagaggaggttccattgattggagcaggaatggcgacagccgtagctacggggagagcgattgagggagcttataagctcaaaaaagttataaatgcgctgagcggaattgatttgactcatctacgcactccgaagatcgaaccgagcgttgtatctaccatacttgagtatcgtgcaagggatgtaccggataaagcgttggctgtaagtgttttatcgaaaaatcggacaattcaagagaaccacaaagaactaatacatataaaggacgaaatcttgccaagattcaaaaaagcgatggaagaagagaaggagatttgtgggatagaggataaaacgatccatccaaaagtcatgatgaaatttaaaatacctagaacgcaacaaccccagatacacatatatagtgcgccgtgggattcagatgatgtcttctttttccattgtatctcacatcatcatgcgaatgaatctttctttcttggatttgatttaagtattgatctagttcactatgaggacctgaccgcgcattggcacgctttaggggcagctcaaacagcggcaggacgtacgcttacggaggcgtataaagaattcttaaacttggcaatttcaaataattacggtactcagatgcacacgcggaggatgataagatctaagacggtgcaccccatttatttgggatcgctccattacgatgtgtctttcgcagacttacgtggaaacgcgcagcgtatagtatacgatgatgaattgcagatgcacatattacggggaccactacactttcaaaggcgagcgatcctgggtgcgttaaagtttggatgtaagatcttaggggatcaaatagacataccactcttcttaagaaatgcttgaacgcagcgacgggaagcgcttacacttac

SEQ ID NO: 97 - DNA, 2921 bp, artificial sequence
  VP2 DNA of BTV9 AJ585130
gttaaaagcttttcaggatggacgagttcggtattccattgtatcgttcgactcatgtgcctcatcacgttttagaagattatgaacttagaattgatttgagtgatcgggtcgtacatggaggggatcgtcacgatccgaaaaaactgaaagagcgtaaagcaattgatgtgccagatggtgatgtcaggttagacttaaactacaaccccactgataatgaagggaatcagatacctggagctcttgatatcgccttatgcgctcggatcacaaggaagagcgttaaaacgaatgagggtgttacgtttacaaccaaccataagtggatggaatggatgcttttagacgcgatggacgttcaacccctgaaaatcgattttgcagcgttaggaggcgcggtcaagtgtgacttgttcaattcagccatatatgttaaaaagaaacacgctgatgcgataatgtacagatatatcgcggtcgaagacgaatcgagaggctgcaaccattccagggtacaagatgtgaaccatctaataaataatgggttatataatgtcgctcaagagtgtgcctatgcctttaaagatacgtacgtattaagagtacattcacaacgcgagaatgttgaggagccttttgagattggcagaccaaaagttggaagtctaggtcgaaacgctgtgataagcatggaaaaccccggatacccactgtttcgcgcaggattacttcagataacagtaagtggaacaataccagctgatataaacgatgaaatgaatcggttgaatcagatacggtccgcgtggattcgagataaagccactagagaggtaaaagcgatcgagttatgcacactgctctcgcggatagggaggttgaagatggatatggaagaggaaccaaaagatgagggagcgatgtctctgagatttcaaggaaagattgataccatgttcttctcggaaaatactgagaaaaccaatataatgcgcaatattagtgggcggacggatgaagagaggttttatgtgttgttattgatctgcgcaacggatgcatatacgcggcgtatatggagatcgaacccgtacccatgtttacgtggaacgttgatcgctacagaatgcgtactcggagatgcatataaaacgcttcgtcagaagtttgactggagtgttcgccatgcagcggataaggcaattgagaatttctcgcatatttttacaagaattaacctattcgatacagggaagactccgggagcgcggattatacattgggttcaggagatgacgatgggcacgaaaacgtcatgggaaagtggatatcctctgaaggatgaagctccagatgatgaattacactgtagagtagatcgggatcaacacagacaaatggttacgagaataattgacggtggatgggatcatgaaaattttaagatacataaactctttcacgaacaaggcaatatatttctaatggattttgaaaaggacgcgagacttacatccagatcggaagttgaatatccgtactactacgatcgatggatttatgcctcgatcttcgacacccgttataaaataatggaaaccgagatagccacagcgaaaaacgcggatccagcaataaagcgaacgttggctcctttgatggatgatccggttatgcttcaattacgaacgatcggaaacttatatgacactcgccctgccatcatgggctctacgttatcagcgcggcaggcacagacatccctacataagaccctcttggacgaggcggagaatggaagatattatagatcgagaggtctcgagaagcgtgccaatccgtgctcggtttgttacacgtcatccttcgtcttacagaaggtatccgagctagtcttgagtctgatgatttatcacgttgaccatgattgggagccgcttaagcaatacaaccatccagatgttctttcagaattctccgaaaccgttcgggaaattcatgatatatctcagctgattgttttattagttgatttattctttgagcagaggcgaaccgttcgcccagttgaagaggcaaggtacgtcatttattcaatacgcgtggcgaggggtgctgatagacttgacacattccggagattctttcccgcgtttggaagggctttagacgtagtaaacagggcaacggacgtcgcgcatatcaccgcgcttaattttctgccttttttcttcctcttaggggataatataatatataagcatagagagtggacggttcctgtcctcatctatacggagggagtcatgatttggccggcgcaggttggtgctaatttcaataggtttggattctgtggatttttgaattacatgcgatttcacgcaggcagccgtttaagagcgaagccacttgatgatgctgaaaagatagtcacacgcgaaatgttgcgttattatatgaagactgacatctttgatggcggggtacaaaagaatatacgagtaacgaaatcatctcagatggagatctatcattcgtcactatgtggaggactttcagatgcggtcgtttatgtattgccaatcagttttccgattaagtgtttaactttgattatagttggtgatgacctggtcgagccgcagatgaggtttggaagggtgatggatttctttaggcatgttgcggaacatgtgcgcggagtcgcttcgatatcaatctcacgaaatggtgacattacaacacattcgcaaggtattgttagggttgaattattgaagaaaaatatccttaagtatcagtttcaggtcgctttgcttaaagtaaaggggttcgttttcggcaacgatgagatcttaattaaactactgaacgtatagtctcagtgacatgggactcctgaagcttacacttac

SEQ ID NO: 98 - DNA, 1635 bp, artificial sequence; identical to SEQ ID NO: 96
  VP5 DNA of BTV9 AJ586708

SEQ ID NO: 99 - DNA, 2926 bp, artificial sequence
  VP2 DNA of BTV10 AJ585131
gttaaaagagtgttctaccatggaggagttcgtcataccagtgttctctgagagagatatcccatattcactgctgaaccactacccattggctatacggatagatgttaaagttgatgacgaagatggaagacataaccttattaagatacctgaatcagatatgatcgacgtaccaaagttgagtgtcatagaagctctaaattataggccaaaaaggaatgatggagtggttgtgccgagattgctagatataacactacacgcttatgacaagaggaaatccacgaaaagcgcgaaaggggttgaatttacaacagatgctaagtggatgaaatgggcaatcgatgataagatggatatacaacctctcaaggttactttggataatcactattccgtaaaccatcagcttttcaattgtatagttaaagcgaggtcagcaaatgcggacaccatctattacgactattatccattggaaaatggagcaaagaaatgtaaccatacaaacctggatttattacgaagtttaacaacgacagagatgttccacatcttacagggagcggcttatgccttaaaaacaacgcatgaactagtagctcattccgaaagggaaagcacgagcgagacttatcaggttgggacgcagagatggatacagctgcgtaaaggtacaaagattgggtatagagggcagccgtacgaacgattcatatccagcttagttcaagtaatcattaaaggaagagttccggatgagattagagacgaaatcgctgaacttaatagaattaaagatgaatggaaaaacgccgcgtatgatagaactaaaatacgcgcattggagctctgcaaaatactctcggcgatcggacgtaaaatgttagatgttcaagaagagccaaaggatgagatggcactatccactagatttcagttcaaattagacgagaaattcattagaaccgatcaagagcacgtaaacatatttgaagtaggtggtcccgcaacagatgatgggagattttacgcgctgatcgctatagcggctaccgatacacaacaaggtcgcgtgtggaggacgaatccttatccgtgtctacgcggtgcgctaattgctgctgagtgtgagcttggcgacgtgtacttcacattgcgccaaacatataagtggagtttgcgttcagaatatggtcaacgtgagaggccgctagaagataataaatatgtattctctcgtcttaatctgtttgacactaacctagctattggagatgaaatcattcactggcggtatgaaatttatcggcctaaagaaacaactcatgatgatggatatatttgtgtatcacagaaggatgatgacgaattattatgtgaaattgacggggataggtataaagagatgtttgatcgtatgattcaaggcggatgggatcaggagcgatttaaactacacaatatattaactgaaccaaacctgcttactatcgacttcgagaaggatgcctatcttggttcgcgctctgaattagtatttccaccttattatgacaaatggatcaactcgccgatgtttaatgccaagcttaagattgcgcgtggcgagatcgcaacccggaaggtggatgacccttggaacaatcgagcggttcatgggtacattaaaacgtcagcggagtctctagggtatgtgttagggccatattatgacctacgtctgcaattattcggcgacgctctcagtctggaacaaaaacagtcagccgtattcgaatatatggctcaacaagatgatttccccgcgctaacagattatacgaaggagaagaacggttgccctcattcaggcggaaccttttacactttccgcaaggtagcgttgatcattttatcgagttatgaacgattggacccaagtttacatgaggggagggagcatgagacatacatgcacccggcaatcaatgatgttttcagacgatacgctttagaaatgaaagaattttctcaactgatttgttttgtgttcgactatattttcgagaagcatgtacagctacgcaacgccaaagaggcgagaagaattatatatttgatacaaaacacgtccggtgtgcaccgattggatattttacgcgaaactttccccaactttcttaggcacgttatgaatttacgcgatgtcaaacgcatatgcgatctgaatgtgattaatttctttccattgttatttctgattcaggataatatttcgtattggcatagacagtggtcgatcccaatgattttgtttggtgaagtcgtcaggctaatccctatcgaagttggggcgtatgcaaatagatttggatttaagagcttcctcaatttcattaggtttcaccccggcgactcaaagaagaagcaggatgcggatgatacccataaagagtttggctcaatatgttttgagtattatactacgacaaaaatttctcaaggtgagatagatgttccggtcatcacatctaaattagacacacttaagttgcatatagcctctttatgtgcgggactagctgattctcttgtgtatacgctgcctgtagcgcatcctaagaaaagtatcgttctcattattgtaggggatgataagcttgagccacaagtacgctcagagcaaatcgtaaataagtatcattattcgcggaggcatatctcaggggtcgtttcgatctgcgtggaccagaacggccaactgaaggtacattctatggggattacgagacatcgaatatgtgataaatcgatattgaaatataaatgtaaagtggtattggttaggatgcccgggcatgtctttggaaatgacgagctaatgacgaagctactaaatgtttaggtcctgtgacacggaccggtagcctcttacacttac

SEQ ID NO: 100 - DNA, 1638 bp, artificial sequence
  VP5 DNA of BTV10 AJ586709
gttaaaaagtgttctcctactcgcagaagatggggaagataatcaaatcgcttagtcgttttgggaaaaaggttggaaatgctttaacatcgaatacagtgaaaaagatttattcaacgattggtaaggcggcggagcgttttgcggagagtgagataggtgcggcgacgattgatggattagtgcagggaagcgttcactcgataataacgggggaatcatatggggaatcggtgaaacaggcggtcctactgaatgtattgggtacgggcgaagagctgcctgatcccctcagcccaggtgagcgcggcatgcagatgaagataaaagagctagaagatgagcaacgtaacgaacttgtgaggcttaaatataataaagagattaccgagaaatttggcaaagagcttggagaggtgtatgacttcatgaacggcgaggcaaaagaagtggaagctgttgaagaacagtatactatgctatgcaaggccgtcgattcttatgagaaaattctgaaggaagaggactcaaagatggctattttggcacgagcgttacagcgagaagcagcagaaagaagtgaagatgaaatcaaaatggtgaaagagtatagacaaaagattgatgcactcaagagcgcgatagagattgagcgtgacgggatgcaggaggaagctatacaagagatcgctggaatgacagcggacgtgttagaagcagcatcagaagaagtgccattgataggtgctggcatggcaacggccgtcgcgacggggcgggcgatagaaggagcgtataaattaaagaaagtcatcaatgcactcagcggaattgatctttcacatatgcgaagccctaagattgagcctaccattatcgccacaactctcgaacataggtttaaagatatacctgatgaacagctggctgttagcgtattaaataagaagacggctgtagctgataattgcagcgagatcgctcatattaagcaagagatattacccaagtttaaacaaataatgaatgaagagaaggaaatagagggcatagaggataaagttatacacccgagagtaatgatgaggtttaagatcccacgtacgcaacagcctcaaattcatatctatgcggctccatgggattcagacgatgtcttctttttccactgtgtgtcccatcatcatcggaatgaatcattcttcctcggctttgatctgggaattgatgtagttcactttgaggacttgaccagccactggcacgcgttaggaatggcacaagaagctagtggacggactttaacggaggcctatagagagttcctcaatctttcgatttcgagtacgtttagcagcgcgatacatgcgaggcgtatgataaggtcacgcgcggtacaccccatctttctaggctcaatgcattacgatataacctatgaagctctgaagaacaacgcgcagcggatagtttacgatgatgaattgcagatgcatatacttagagggccgttacattttcagcgtcgagcgatattgggtgcgttaaaattcggagttaaaatcttaggtgataaaatagatgttcccctcttcttacggaatgcttgaacgcagcgggggaggaacttccacttac

SEQ ID NO: 101 - DNA, 2926 bp, artificial sequence
  VP2 DNA of BTV11 AJ585132
gttaaaagagtgtcccatcatggaggagttcgtcatacccgtctattcggaaacagacattccgtactcgttgttaagccactacccgttagccattcgtacagatgttaaaatagcagacaccgatgagggccatgatgtagtgaagataccagaatcagatatgatagacgtcccaagagtagacattgtggaggccctcgccgctaagcctatgaggaatgacgggatcgtggttcctagactgcttgatattactcttcgagcttatgacgatagaaaagcaataaaaagcgcacgaggtgtagagtttatgacgaatgctaaatggatgaagtgggcgatcgacgatagaatggatattcagccactgaaagtagccatagaccattataatgctgttaaccaccaactttttaattgtattgttaaggctaggtccgcaaacgcagatacaatttattatgactattttcctctcgagagtaaagtgaagaagtgtaatcatgccaacctggacctgttaagaagtctgacaaacactgagatgtttcacatgttgcagggggcagcttatagtttaaaatcgaattatgaactgatcacaaattctgagaggaatagtaccgaagaaacttacgcgcctggagtgcacaatcaaattcgcttagtgagaggcacgcgaatcgggtataagggtgaagcatatagccgatttgtttctagtctagtacaagttaggatacaaggacggacaccacctgagatagttgacgatatcgcgcggctaaatgtgatcaggacggagtggatcaacgcgcaatttgatagcaccaagatacgagcgttggaactatgtaaaatactttcagcgattgggcgtaagatgttaaacacacatgaggaaccaaaagatgagatggatttatccacaaagtttcagttcaaattagatgataaatttaagaagacagattcggaacatataaacatatttaacgtcagagcaccggcgacacatgagggtaggttttacgccttaatagcaattgcggcgaccgatacgcagcgtggtaggatttggaggacaaacccgtatccgtgtctaagaggcgcgctgatagcagcggaatgtgagctcggagacgtatatcatactttgcgccaagtctacaaatggagcttgcgacaagattatggtcgtacagaggtccctctagagaacaacaaatacgtattcagccgaattaatctgtttgattcaaatctggatgtgggcgatcaagtagtacattggatgtatgaagttgacggcccagctgagacaacgtatgacaacggttatatgtgtaagacggagcgggaggatgaagagttagtgtgcaaaattagcgaagagaaatataagacaatgctcgatagaatgatccagggtggttgggatcaggaaagattcaagctttacagtatactgacagatccaaatttacttacgatagactttgaaaaggatgcgcatctgaatattagatcagaattcgtgctcccaagttatttcgatcaatggatctactcacccatgtttaacgcgcggttgcgaataactcatggagagattgcgactagaaagtcagcagatccgtggaataagcgtgtcgtatttggatatattaaagcatcgacagagagtcctgaatacgcccttggacaatatttcgacatgcgtatacaattttatggggatgcgctaagctcgaagcagaatcaatcagcggtctttcagtatctgagccaacaagaggactttcctacgctgacgagctatgccaaaggtgatgtggtgtgtcctcattcaggtggcgcgctgtatacttttcggagggtggcactgatgctgatggcgaattacgaaaagttgagcccggacttgcatgaaggtatggaagattacacttatacgcatcccagtatcggtggcgcctatcaaaaacgcattcttgagatgagagatttttcgcaactaatatgtttcataatcgattatatatttgagaggcatgatcaactgcgtgatgcaaaggaggcgaggaggattttgtatttaattcaaaacttggacgagccgcagcgactagagatgttaaatgttacgtttcctaacttctttcgtcatttcttgaaattaaaggatgttcagctaatcagtgatttgaacgtgataaacttcttaccgctgttgtttctagtgcaggataatatatcctattggcataggcaatgggcggtccccatgatactatacgatgacgtaatcagactaatccctgtagaggtcggagcgtatgcgaacagattcggaataaagagtttcttcaactttacgagatttcaccctggcgatgcgaaaaaacgacagaaagccgacgatacacacaaagagtttggatcgatcagctttaattattacgcaagtactaagattgcgcagggaggggtgcatacgccagtagttacaaccaagctagacacgctgaagattcatctgtcgtctctttgcgctggcttagcggattcgattgtttacacgctgccggtcgcacatcctaaaaaatgcattgtgctaataatcgtaggagatgataagctagaaccgcatgtgcggtcggaacaggtcgttagtaagtattatttctcgcgtagacacgttagcggaatagtgtctatatgtgtcggacaggataatcaactaaaggtatattcatcaggtatcgtcagacatagagtatgtgagaaatttatcctgaagtataagtgtaaagtggtgttagttaagatgcccggatatgtattcggtaacgatgaattaatgacgaaactattaaatgtttaggtcctttgacacggaccgatggcctcttacacttac

SEQ ID NO: 102 - DNA, 1638 bp, artificial sequence
  VP5 DNA of BTV11 AJ586710
gttaaaaagtattctcctactcgcagaagatggggaagataattaaatcgctaagtagatttggaaagaaagttggaagcgcattgtcgtcaaacacagcgaagaaaatttattcaactattggaaaggcagcggagcgttttgctgaaagcgagatcggtgcggcgacaatagatgggttggtgcagggtagcgttcattccataatcacaggtgaatcgtatggagagtcagttaagcaggcggttcttctcaacgtgttaggtacaggtgaagagttaccagacccactgagccctggcgaacgtggcatgcaaacgaaaataaaggagttggaagacgagcagcggaatgagcttgtccgattgaaatataataaagagataacaaaagagtttgggaaggagctagaagaggtgtacgacttcatgaatggcgaggcgaaagaggaggaagtggttcaggaacaatactcaatgctatgcaaagcagtagattcatatgagaaaatattaaaagcagaggactcgaaaatggcaatattagcacgcgcattgcagcgggaggcttcagaaagaagtcaagatgaaatcaaaatggtgaaggagtacagacagaaaattgatgcgcttaaaaatgcgatcgagattgaacgagacggaatgcaggaggaggcgatccaggagattgccggaatgaccgctgacgtcttagaagcggcatcggaggaggtgcctttaatcggcgcaggtatggccacagctgtagcgaccggtagggcgatagagggcgcatataaattgaaaaaagtcataaacgcgttaagtgggattgatttatcgcatatgaggagtccaaagattgaacccactattatcgccacgacattggagcatcgatttaaagagataccggacgagcagctagcggtaagtgttttgaataaaaagacagctgtaactgataattgcaatgagatcgcgcatatcaaacaagaaatattacccaagtttaaacaaattatggatgaggagaaggagattgagggaatagaggataaagtgattcatccgcgtgtgatgatgaggttcaaaattcctagaacgcagcaaccgcaaatccacatttatgcagccccctgggattctgatgatgtgtttttctttcattgcgtttcacaccatcatcggaacgaatcttttttcctgggatttgatctaggaatcgatgtcgttcactttgaagatttaactagtcattggcacgcattgggattagcgcaagaggcgagcgggcgtacgttaacggaggcgtatcgtgagtttctcaacttatcaatttcaagcacatatagcagcgctatacatgcgaggcgtatgatcaggtcgcgagcagtacacccaatttttctaggatcgatgcactacgatattacgtatgaagctttaaaaaacaacgcgcagagaatagtctatgatgaggagctgcaaatgcatattctaaggggacctttgcactttcagcgtcgagccatcctgggggcgttgaaatttggagttaaaatattaggcgataaaattgatgttcccctcttcttacgaaatgcatgaacgcagcgagggagaaacttacacttac

SEQ ID NO: 103 - DNA, 2904 bp, artificial sequence
  VP2 DNA of BTV12 AJ585133
gttaaaagttgcgaggatggaggattttccgatatgcgtaattgaacgcgagtccaagtttgatgaagatttcgtcgtgagatatccggtgataattgatttaaaagaatgtgtggatgatgtaaatgggaagacggatgtgtcgaagctggaggaaactcggggaattttcgttcgtgctgagggcatacgagtcgcattaaattcaagaccagacaatttatctcatgttataacaccgtccgctttagatgtgttgattcgggcgtatgatagaaagcacaaaattgcgttagacaaacgtacggatgattctggcagaatggcggatcacaatatagatgtgtgggttaagaagcggttggaagagcaagcggatttacaagccatatatcatgatgttgatttaggacgtggtaagttaaagtttaaaatgctaacggggttggtgaagctagattcgaattatgcggaaacagttggctacgattatgcaccggtgccgaaagtgggatgcgatcatgggaatgtcgattttctatatgacttcattttatcgggtagcctccaggtatcgaagaccgcgggatacactttgaagcaaacgtatcgattaactgtgcacgctgaagctaacgcagaaacacgagatcaactcatcgtaaatggggtgtataccgagggcgttacgcgcggtgaggagataagggatatgaagaaaatgtgttattcaagattccgtgatggatggattcgagctactatacagcccaaaatagtcgaggagttgagacggagtaaggaggcgctagacagaatatcgagtgaatggtatgaaaagttgacgacgccagacgttgttgaaatatgtaaaatcgtgtcatcaattggacgtcagatgtggaatagtgaggaattgccggtcgatgatgcaatgagatctaaagtttttcaggaagagttgcggctgttattccgagttgggaatagcgaatatgatacaattcaggctatccagagtggacaaacgcctttgaagaaattctatgccttgttagcgattgccgcgactgacagctatcgttggcgcatatggtggagtaatccgtacccctgcttacgaggaacgatcattgcgtgtgagatggaactaggggacgtctacgaaactttaagatcaactttccattggagtttacgtcctacatatgctacccggaaggagattgatcgcgaacgaagagcctatccatatcagagaataaacctctttgaatcgcgtttagatcctggaacccgcataatcaattggttggtagtaagggagccgttagctgaaccagacgtcaagtccggtcgtgtgtgtatgacgtcgacagaatctgaatacattctaaaggtggatgacacgaagtatagagaaatgattggtcagataattgagcgggggtgggagaaagaacatttgaaactggaaaagattgtccaggatgagggtaacgtgtttcaaatggaatttgaaaaagatgcgagcttagatgagaggagccatttagttatgccgtattattatgataaagaaatacactgtccgatgtatcataagaagattaaaataacagaggctgagattgcaacttcatggagtgatgacccatggttaaatcgcgtgttaaatggatttttaggcgaccatgtggagacgtttaatttagggtgcaaccacatattcgacatgcgagtacctttaaaaggaaatttactgacacaagagcaggctatctcaagttaccacgaacacattaggtcgccggaagcacagagcgagaaccaatgtgcactgaaggtatatgcggatgaggcggtcagtaagctgtttactactttgtatcacagactagcctatcatcttccaaagacggagtacatagagcgagaagaggaggtgagtcagtatgagggattagtaaagagaattcgtacatgggaccagttcattatattcgtatttgatttcttctttgaaaatagaaaagggttacgcacgacggaggaggcgacacagcttgctaaggcaataaggagtaatgttggcgcgacgcgatggacgatgatggcgagtgcgtttcctaccagcgtcagattagtgaagggaatccttcgagcgaagacgtggggtgaatgttatataatgaatttcttaccattgttaatatgtgggggctcatcgatcagctatttacacagagaatggagttatcatatgatcgtagtctttgaggatggtataaaggtggttccagctatgaccggacgctcacttacacaaggttcgctgggagagtgggcatcttttgtgtgcttctttatgggttcgaatcacgaaaagataaaactcgaagaagacgaacttgaggttttgcgaaagtgcgttgagttttacgaaggtgtaaaaatggttgatatcatcaaagatactccggttcgaatgactaagtatattgcatgtgatttagcgtttggtagcggatgtggtggaacaagtgaatcacttagcttcatactgccagtcacacatcctaacagaagcttgattatttttgtggtggcggacgataagataagcccagcgcagcatgccgcgagagcaaaacgtagattccgtgggacgcgcgaatacgtaaatgatgtaatcgtattacagatgaaacgacctggcacagtcggcaacgtttggagtgagaaacatagtaaagtgagaatatgtcgaaggaattttctaaaatatgatcacaaagtggttcttacgaagttcgcagggttagtctatgggaattacgaactaattacgaaactcgcaaatctatgagcccttgacaaggctccctcgcggcttcaacttac

SEQ ID NO: 104 - DNA, 1645 bp, artificial sequence
  VP5 DNA of BTV 12 AJ586711
gttaaaaagcagccaccaaacatcgcatgatggggaagatcattaaatcgctggggaagttcgggaaaaaggtaggcaatgcgttgacttcgaagacggcgcaaaagatttacaggacgatcggaagtgcggctgaaaggtttgctgagagtgagattggcagcgcagccatcgatggattaattcagggtagtgttcactcaataatgacaggtgattcgtatggtgaaagtgtgaagcaagcggttattctaaatgtcttaggagggggagatacgattgcggacccactaagccccggagagaatgagatatataggaaactgaaacaacttgaggatgagcagaagggggagatagttaggacaaaacataatacagaaattctgaagaagttcggaaacgatttggatgaagtgtacaaatttgcaacacaagaacataaagttggcgagcatgaagaagatcaaataaaaatgctggagaaggcgctaaaatcatatattggggttttcaaggctgaaaacgatagcattgacaaattgaagaaagcgttgtatgtcgaatcgacggagcggacggaagaagaaactaagatgataagtgaataccgtgataaaattgatgcgttgcgaagtgcaattgaggttgagaaggaagggttgcaagaagaagcaattcaggaaattgcaggtatgagcgcagaagtattagaagcggcggcagaagaggttccgttatttggggcgggcgtagctacgagcatcgcgacggcgagggcgatagaaggcgcatataagattaaggctgtaattagtgcattaaccggcatagatttaactcatcttaacgtgcctaaagttcaacctaagacgctagaagcgatcctcgatgtaccaaaaggtgtagatattccagatctgcgtttaacggagggactcatcgcgaaaatggataaaatttcagagaatatatctgaagttgatcacatacagaacgtcatcgttccgaagctaaagaaagcggttgaggaggataaagaaaacattacggattggtctgaaaagcgcattcatccgaaaacagcgcaacggtttaagataccacagacgcagaagccttcgatgcacatatatgcggctccctgggactcggatgaagttttcatctttcatgtaatttcacctcatcataagaatgaatcattcttcttgggattcgatcttgagattgaatatgttttttatgaagatttgactcaacattggcacgcattagggacagctcaatctacctatggcagaactttccgtgaggcgtataaggagttcttcttacttgcctctaacgtcgcaggacaaacagcaatccatcagcgtaggttgctaagatccagaagtaaccatccgatttatttaggaatgcatgattatgaagtttcgtacgctcaaatgaagatgaacgcgatggcgttggttagcaatgaggatttgcagatgcacatattgcgtggacccatacactttcaaagacgtacaatcgttgcggcattgaaatatgggattaagattttaacccagcctgatgacgtctccatcatgcttcgaaacgcgtgagggcggatgcaggggctacttacacttac

SEQ ID NO: 105 - DNA, 2935 bp, artificial sequence
  VP2 DNA of BTV13 AJ585134
gttaaaaacgctagcccgaggatggaagagctcgtgatacctgtgataaccgaacgattcgataagagattagtagggcgttatgattatgtgattgagttggcgaggccagaaggcgatgaatggagcggtcacgatgttacgcatatcccagataagcgaatgtttgacattaaggttcaaccaataagagatgcaattgattacaagccagttgaaaatgatggagaggttttacctcgtattttggatatgtcaatcgcatgctatgacatgaggaaaagaatgatgaaaagagatggcgtagattttgtttcaaacactaaatggctagagtggatgatccaagattcaatggatgtgcagcctttgcgggttgatatgaaagaagaccatagtacggtacaatacgacatgttttcagcaaaactgcatgtcgattcgaggaaagcggataccacgtcatacaatatacttgctctcgaggtgaagaaaggagcacagtgccatcatgtgcatgctaacatttggaaccatatgatacgtaatcatttgtttcacgcggtgcaagaatcatgctatatctttaagcctacttacaaattgatcgttaactctgagcggaggacccctgatgaggattttcagattggtaatcctcagtttccaacgctaaggcgcaaccagcagatatttttaggtgatgacgcgtataagaaaactgcgagaggattggttcaggtcttagtcaatggtgtcgtgccggacataataagaaatgagatagcggcactggatgcaatacgtgacagatggatacagggaaattatgagcgcactcacataaaatcactcgaactgtgtaatctattatccgccattggtagaaaaatggttaatcttgaagaggaaccgaaagatgagagaaatttatccctcagatttcaacataaacttgatgataaatttgcgaagaatgatcaagagaggaatgtcatatttgcgcaaaagagtcagcgtaatgatcaggatcggttctacgtgctgatggtgatagctgcttcagacacaaacaatagtagggtttggtggtctaatccatacccttgtttacgaggtgcgctaatcgcggctgagtgcaaattaggtgacgtctattataaattgcgatcatggtatgagtggagcgtacgtgagggatataagccacgagatctggatcgccagtatgaaaaatatattgtgggacgtgtgaatctgtttgatttggaggcggaacctggaacaaaagtgttgcattgggagtatgagcttatctcaaaattatatatcgttagcaatcatgagggtaaccagtgcgatttgtacccagatgagggtgaaatcgtggccaagttcgacgatgcacggtatagtgatatgattcaaacgataataaacgaaggatggaagcaaggcgattttaaaatgtttaaagtgttgaaggatgaaggtaacccattactatacgatttagagaaggacattaagttggatcgcgtttcgcgagtagtattcccaccgtattttgatcaatggacctacgttcccatgtttaacgccaggataaagccgtgtgaggtggagctggctgaacgtaagaacaccgatccctatgtaaagcggacgcttaagcctttgaaagcggattgcatcgagttaatgcgctaccatatgtctcagtacatggatttgagagtatcgttgcaagggacgagtttgagcattaagcaagtcccctcgagcatacaccaatcgctcgctcaagatgcatcttacgcgggaattctcagccgacgtagagaaaacttagactataaatcccaatgcccgatcgtaactaaccttttcttattggagaaattctttctactgattttcactacgatggagaagcactattgggaaatggatgatgatgaaacacagtatgagcatcctaagatagatccatcaaagtttgaggtggagggcacactacatgatgtttcgcaggtcatggttcatctactcgataggttctttgagaagaggcgtttcctgaggacggttgatgagtctagatggattttacacctgatccgatccacgagtggctccaaaaggctcgaagtgttatcgagattttttcctgcgtttagtgacggattacgcattcgtgaatttaagaaagtaagggacataatgttattaaatttcttgcctttcttatttctaacaggtgacaacatggcttatgaacataggcaatgggcggttccagttattttctatgcagataaaatcaggattgtcccggcggaggtaggcgcatactataatcggttcggtttaacgtgcattctggaattgatgatgttctttccttcctacgatactcgaaatgaggatctcggtgaagatgtacgcgcatgtataggcccaatcatcaattactatctagatactacgatttcgaatggtggcattcagacaagtattgtttctacgaaagcgttgctttatgaaacgtatttgtcctccatatgtggtggcttttcagaagcgatcctatggtatttaccagtcactcatccttctaaatgcttgatcgcgcttgaggtttcagatgcactaacgagtcccgaactacgtattgacagaattagacgaaggtttcctttatcgagtaaccatttaaaagggattgtacaagtttcagttcgacctgatcgtacgtttagtgttatcacacaaggcattgttaagcatagagtttgcaaaaagacgctgttgagacataggtgtgatgtgatcttaatacagactccgggctacgtcttcggtaacgatgaattacttacgaaactcttaaatatataatcccgtgactgggattgggcacgtttacacttac

SEQ ID NO: 106 - DNA, 1637 bp, artificial sequence
  VP5 DNA of BTV13 AJ586713
gttaaaaagttcctcaagatcgcggaagatggggaagatcataaaatcacttagccgttttggcaaaaaagtgggtaatgcattgacctcgaatacagctaaaaagatttataacacaatcgggaaggcggcggaacgttttgctgagagtgagatcggttcggccgcgattgatgggctggttcaaggaagcgttcattcaatcatgacgggggaatcctatggtgaatcagttaagcaggcggtgctgttgaatgtgcttggtgcaggagatgaaatcccggatccactcagtcctggagagcgtggtatccagatgaaaatcaaggagatcgaggaagagcagaggaacgagttagtgagaataaaatacggaaaagagataagagagaaatttggtgagcaattggaagaaatataccaattcatgaacggcgaagttaagggagaagaagagcaagaggagcaatataaagtcttatgtaaggccgttgactcatatgaaaacctactcgtcacagagaatgagcagatgcgtacgttagcgcgcgcgttacagcgggaagcgactgaacgaacagaaaacgaatcgaagatggtcaaggaatataggcagaaaatagacgccttaaaggctgcaatagaggtggaaagggatggtatgcaagaggaggcaatccaagagatcgcgggcatgacggcggacgttttggaagcagcatcggaagaagtccctcttgtaggatcgggaatggcgacggctattgcaacaggtagagcgattgagggtgcgtacaaacttaagaaagtgataaacgctttaagtggcattgacttatcgcatttacgtactccaaagattgagccaaccatggttgcgacaacgttagagcatagattcaaagaaataccggataaagaactagctgtgagcgtcttagcgaaaaacgatgcgatagtagcgaatactaaggagattaaacacataaaagaggagattctaccaaaatttaagaagatcatggaagaagagaaagaattggagggtatagacgacaagaagatacatccgagggtgatgatgagatttaaggtacctagatcacagcagccgcaaattcacatatacagtgcgccgtgggactcagacgatgtatttttctttcactgtgtgtcgcacttccatgcgaatgaatcattctttctgggcttcgatttgggaattgatgttgttcatttcgaggatctcgctgcgcactggcatgcgttaggcgcagctcaagaagcaaagggacgtacactaaatgaggcgtacagagaatttcttaatctgtccattggaagcacgttcacatcgccaatgcatgcacggcgtatgattaggtcgaaaactgttcaccccatttatttaggctcgatgcattacgatattacttatgaaacgttaaagacgaacgcgcagaagcttgtatatgacgaagatttacaaatgcacatattaagggggcccttacactttcagcgacgcgctatattaggtgcgttgaagtttggtgtaaaagtgttaggtgataaaattgatgttccgctcttcctaaaaaacgcgtgacagcggtgatcccggggcttacacttac

SEQ ID NO: 107 - DNA, 2922 bp, artificial sequence
  VP2 DNA of BTV14 AJ585135
gttaaattagtttcgtgatggatgagctagcgatcccaattataaatggacacttcccaaaagagacgttaatagagtatgattgtatcattgagttaaatccgccagttgaagatgatgcagccgatgtggttcagatcccaacaagggacatgatggatattccgaatgtgccgatacgtgatgccttgaaacacctaccacagagaaatgatggtcacgtcttgacccgagtacttgacatctctttaagcgggtatgaccggaggaaatatcacaagacgaatagtggaggggaattctattcaccgaacgagtggcttaactggatgatcaatgactcaatggatgtgcagccactgaaggttagcttaggtttgccaccaactattagacatgaattgtttagctcgagcgtgtttatatccgcgaaaaaggctgacaccacatcataccatattgaaccaatatgtgagaaagacaaagcatgcgatcatacgcgcgtttccatgtggaataatctaacgaggcatgaaatgatgcactgcgcgcaagagagtgcatatgtgttaaaaccaacttacgatataactgtttattcagaaagagccacaactgatgaggcgttccagcaggtggggcagaagttcgttactataaccaaaaaccatcgagtggtactgggtgatgatgcttataagaaaacgttgggcggattaactaggttgcgtgtgcaggggaaaataccatctctgatacaaaatgatatacagcagttgaaccaaattagggatacgtggattagagattcatataatccgaggaatatacgatcgctagaattgtgtaaattgctgtcgggtataggtaggaagatggtttgtatagaagaggaaccgaagaatgagagtgacttatcagtgaaatttcaatttaaactcgacgagaagtttcgacttgatgatagtgaacgtggggtcatcttcacaaataaaggtcagagaaatgatcaagatcgtttttacgttctaatcatgatagcagcatcggacacgtataacagccgtatctggtggacgaatccgtacccttgtttacgcggcgcactgattgcggcggagacacaattaggtgatgtgtattggaccttaaggcatttttacgaatggagtgtaagaccagcatattccccgaggttgagggagcgtgaggatgacaaatatatatatggcagagtaaacttattcgatttagatgcgagtcctggtacaaagataatacattggacatacgatctgattacgcgggagagtaagattacatatcataacggaaatccatgtgatttgaacccggatgtggacggcatcatcacaaagtttaacaaaactgcctatacagatatgatcggtgagttgcttaatggcgggtggaacacccgtgaattcaagatgtataaaatattagagagtgtagggaatgttctaaccattgactttgaaaaggatgcgaaactcaactctcgatccgagtttattttgcctgactattacgacaaatggatatatgcgcctatgttcaatgcgaagcttaagataacagaagttgaaattgcgcaggccaaaagtgacgatccggacgtagtgagaaccttagcacctattggctcagatccgattactttgcaacggttgtgcttaggaaattattatgatatcagacccgcaatgcatggacgcgcattgatgaagaaacaggagcagacgtcctatcataagaccttggctaaaacgaaggattacagtgatgtacttaatcgaagagggtatcgtaaagttgagaagccatgtccaatggtaacgtgctcgtacgtattggagaaaacggctttattttggatcgacgttatggagaagcatgttggggacattgaagacagtacggatgagttcgacttcccaagggtggatgtaactttaccggtggagactcacaaagttgtagatgtcgctcaactgtcagtgcttcttatagactttctgtatgaaaaacgacgtacagtgcgagatatcgatagcgctagatggacgatcgaattgatcagacgagtgagggggaaggatcgacttgaagcgattcgtcgggagtttccaaactttggtgaagcggttacgattcttatgaatcctacgagagttaaagatgttatggttattaactttctcccatttcttatcttgttgggtgataacatctcgtacgaacacagacaatggtccattccgataattttacatgcggattcaatgtggtttctcccggtggaggtaggggcgttctataatcgatttggtgtcatatcgttcttagagtatatgatgttttttccatctgcacagtcgagggagtctgagctggatgaagcgaagattaaggtatcaaagttaatcttagaattctatctagatacaaccattttttcaggtggcgtacaacgaagcgtcgtttctaccaagcagatactttacgaaacttatctatcatcactatgcggtgggtactccgaggggttggtttggtatttaccgatcactcatccgacgaagtgcgtcgtcgccattgaattttctgatgatagggttgatgcagctcacaggtgtaaccggcttcgcgcgagatttcccttaagcgcagtgcatctgaaaggaatagtgattctttcgatagctaaagatagagcggttaaggcgtatactgaaggtatagttacgcatcgtttatgcaagaaaaatgtgcttgggttcacttgccaaattctactgttaaagttctcaggacatgtatttgggaatgatgaaatgctaacaaagctgcttaacgtttaacctcagtgacatgaggtgcacgaactaatcaacttac

SEQ ID NO: 108 - DNA, 1637 bp, artificial sequence
  VP5 DNA of BTV14 AJ586714
gttaaaaagttccccatgatcgcgaaagatgggcaaaataatcaagtcgctgagccgttttggcaaaaaagtaggcaatgctttgacatcaaatacagcaaagaagatttacagtacgattggaaaggcagcggagcggttcgctgagagtgaaatcgggtcggctgcaattgatgggttagtccagggtagcgttcactcaattatgacgggcgaatcctatggagagtcggtcaagcaagcggtgctgctgaacgtgttaggggcgggggatgagattccggatccgttaagtccaggtgagcgtggcatccagatgaagataaaagagttggaagaagaacagagaaatgagttagttaggttgaagcacgggaaagagatcacgaagaagtttggcgaggagctagaagaaatatatcaattcatgaatggggaggttaaggatgaggatgagcagaaaaaacagtatgagatgctttgcaaggctgtcgattcatatgagaagttactcgtggcggagaatgacgagatgcgcacgttggctcgcgctctgcgacgggaaacgactgaacgaacggaggttgaatctaagatggtgaaagaatatagacaaaagatagacgccctaaaagcggcgattgaggtacaaagagatgggatgcaggaggagggaattcaagagatcgcgggtatgacagctgatgtgttagaagccgcctcagaggaagtaccattagtgggatcggggatggcaaccgccatagcgaccggacgagcgatagagggcgcgtataaattaaagaaagtgataaacgcgttaagcggtatcgatctttcacatctacgaacaccgaaaatagagcccaccatgttcgcgaccaccttagaacacagatttagagatatacctgataaggagctagcagtcagcattctagcgaagaacaacgcaattgtggcgaatacgagggaagttcagcacataaaagaagaaattctgcctaaattcaagaagataatggacgaagagaaagagttggaaggtattgatgataagagaatacacccaagggttatgatgaggttcaaagtgccacgatcgcagcaacctcagatccatatctacagcgcgccgtgggattcagatgatgtgtttttctttcattgcgtttcgcattttcatatgaatgaatctttctttttaggttttgatctggggattgatgttgtccactttgaggatctagccgctcactggcacgcgctcggggctgctcaggaagcaaagggacgtactctaaacgaggcgtacaaggaatttcttaacctatcaattggcagcacctatacatcaccaatgcatgcgagacgtatgattagatctaaaactgtccaccctatctacttaggctcgatgcactatgatatcacttacgagacgttaaaatcaaacgcacaaaggatcgtttatgatgatgaacttcagatgcatatactgagagggccgttacactttcaacggcgcgcaatactaggagcgcttaaattcggagtaaaagtgctaggcgacaagattgatgtgccactctttctaaaaaacgcgtgactgcggtgatcccgggacttctacttac

SEQ ID NO: 109 - DNA, 2909 bp, artificial sequence
  VP2 DNA of BTV15 AJ585136
gttaaaagttgccgggatggaggatttccctgtgagcgtgatcgaacgtaattcaaccatcgcaccagcgattataaagagatatcccatcatagtcgatgttaggaatatggtcgctttatcgggagggaagaatgatgttaccaacataccacgagtgcgaaacataggtgtaagacaagaagggatacgtgttggactgaaatatcgtccagatactgagacgaatgttatctttcctaaaaatttagacgttctaataagagcatacgatcataaacatcgattgacgagggataagagaccgactgaccatgacgtggactctatttcagacggcgacgttacggtgtgggtaacgaatcgaacgaatgagttctatgatatacaaccaatttaccacacgttggaggacgaagtctgcaaagtaaaattcacctcgctacttgggagcgtttcaaccgattcaaattatgcggaaagtatgtcttatcattatatcggtgttgaacgcgataagtgcgatcactcaaagtggcatagattttttcccatgcttttgtcagattcgattaacttaggcaaggaggtaggttacatattgaaaaaaacgtataaaattaaggctataggagaggctcgggagggacaaagacaggagttgcgagtggatgtcccatatacccctggcataggaagaaacgagaggatcagcgacatgaagttgcccgtatataagcgtttcctcgaaggctacatacgctgtcaaatcgagccaaacgtccccgagaagttaaccgagctgaagaatcagcttgatgcgatctgtgtggcgtggtatggtggacaggtgcccatagtcgctgatgaaatctgcaaaattacctcgcggattggacgtctaatgtggaatacggaagaagagcccgttgatgagactatgagatcaagagcatttcaagaaagtattcgattgatgttccgcacggagaacagcgaatataataatatacaagcgataggcagtggcagaacgcagaggcagaagttttatgcacctctaataatcgcagcgaccgatagttttaggtggcgcatatggtggaacaacccatacccgtgtctacgtggttgcctgatagcatgtgagatggagctaggtgacgtttacaaaagtctaaaatcgatctataagtggaccttacgctcaagctattcttcccagcgtgaaatagatagacaactcaacgtatttccgtatcagaagatcaatttattcgatttttccggaacaccaggcactgaaataatacattggagaattgttcacatacctgtgccggatgagatcgattatgaacatggatatttatgcccagaaagtggagattatgacattgtcatggccgttgatgatgatttatacagcgcttttaagcatagagtaattgatcgggggtgggagcatcaggccatgaagttagatgaattggtaccacaggagaataatatatttaaaatggaattcgaaaaagatgcgtaccttgacaatcgtaaccacttggttttgcctccgtattataacaaagtagtatattgtcctttgtttcacgccacagcaaagattacaccgacagaaatttctcatcgccaaagcgacgacccatggtgcgaacgaacgttgtatgggttcaggggcgatcatgtcataacacattatactggactgaatcacattgtgaaccgacggaagcctctcatgggtcagacgttatcggtggcccaaagtatgggagactatactaaatatatattaggcgacgatgggtcagctaacagttgcacagggaccgcgtattcgtcgcgattaccaacaatgttgtttcaggatatctttgacgcgattattcgacatcttccaaaagttatattgaaggaccaagctgattatttctccgagtcgaggaaacgtgttagtgatatcattgattgggatacttttatcgtgtatagtatctacgcttgctttgaaaggaagaatcaagttctaagggaagaggatgcgacgcagattgtccgaggaataagcacggcgggaaaagagaaaagacttaagttgattgaaagaagttttcccatttactatcgagaactgatgaagatcaagaatgcgaagacgtggaaggacgcttacgcctttaatttcttaccattactattgtgtgctggcacgaatgtgcaatacgtacacagacagtggtcctatccggtattggtttcgatggagaagggaccgcgtattattcctgcgatggtgggaagggatttggcagatgggaatctaggcgattggcacgcatacattaagtactatatgggacagcatatggaagaccaagaggtggaggaggacagcttggagattctaaagatttcgcttgaacattatatgtctcacagttatatctctaacgttaaggatgttgcggtcaggatgacgaaggagattgttttagatttatacttcgcgtctgggtgcaatggagtaagtgaaatgatgaccttcctattaccaattatacatccgcggaaaggtttggtgatgttttgtatagcggatgaccaagtgcaaccgcaggttcaatgtgagacggcgcttcgtagatttccttatacgcgcgaatatatacatgacgtcattgttatccaggttgggaggccgggtgagcttaagcaagtttggaagcgcggtagcactaaagtgaaagtatgtcgacgaaattttttgaggtatgatcacaaagtcattctgtctaggttatgtgggttagtttatggtaactatgagttgatgaccaagcttacaaatatatgagctagtgacatagctcacccgcaactaaacttac

SEQ ID NO: 110 - DNA, 1639 bp, artificial sequence
  VP5 DNA of BTV15 AJ586716
gttaaaaagtccttggtatcctgcatcatgggaaaaatcattaagtccctcggaaagttcggaaagaagatcagtagtgcattgggttccagtacagcaaagaaaatttattcaacgattgggaaagcagctgaaaggttcgtagaaagtgatctcggcagcgcaactatagatggcattatacagggcagtgtgcattcagcgttgacgggcgagtcgtatggggagagcgtaaaacaggcggtaattctaaatgtagtgggtggaggcgattcaatagctgaccccttaagtccgggtgagaacgacatggtgcatcgtctgaagaggttggaggatgagcagaagggagaaattatacgtacgaagcacaatgcgcaggtaatcgctaaattcgggcgcgatcttgaagatgtctacaaatttgcgtcacgagaacataaagtcggagaggaggaggaggaccagatccagatgctggaaaaagcgttgcgagcgtacgggaacgtagtgaaggtcgaaggagaaagcgttcagaaattagcgaaggccttacgcgtggatgaggaggaacgcaccgatgaagagacacgtatgattggagagtaccgtgataaaattgatgcgctatcaaaagccatagagatagaacgtgaaggtttacaggatgaagcaatacaggagattgcggggatgagcgcggaagtacttgaagcggcggcagaggaagttccgatttttggcgctggggtggcgacaagtatcgcaacagcgcgagcgatagaaggtgcttataaattgaaagcggtaataaccgccttgaccgggattgatctaagtcatatgacaactccaaagatccaacctaaaacgttagaagccatattggatgcgccgggggggaatgtaacggacttgatgctgacgcgggggttggactcaaaaattgacaagatcaacgagaatctggctgaagtggaacatatgcagacgtcaattttaccacgcatcaaaaaagcgattgaagaggatagagatgaaattacgaattggtcaccgaagcggatacatccgaaaagcgtccaaaggtttcgcgtgcctcgaatgcaaacgccatcgattcatatttatgcggctccatgggattcggacagcgtattcatctttcacgtaatctcgccacatcatttgaacgaatcattcttcttgggctttgatttagaaatcgaatatgtgcattacgaagatctggcgcaacactggcattcgttgggagctgcacaggaagttacgggcaggactttccgcgaggcgtatcgagagttctttaacctggcgtcgagatcaactatggcgagtgacattcacaagaaacgtttacaacgctcccgcatgtcccatcctatttatctaggtgttcataattatgagctttcatacatcgcgattaaaagtaatgcgatgcaattggtgacggatgaagaccttcaaaaacatgtcctcagagggccgctacacttccagcgacgtgtgattatggcagctttaaaatatggtgtaaaggtgatgtcgagggcggatgatatcgccatgatgctcagagacgcgtgaaggcggggagacaacgacttacacttac

SEQ ID NO: 111 - DNA, 2935 bp, artificial sequence
  VP2 DNA of BTV16 AJ585137
gttaaaaacgttagcctagagatggaggagctagttataccagtcataactcgtcaatttgataaaaaactggttgggcgttacgattacgtcattgaactgacggaaccagaggacggcgagtggagtggccacgatgtcacagagattccaaatagacgcatgtttgacattaagcagcaaaatatcagagaggcaatagaatacaaacctgtagataacgatggggaagttttgccgcgcatcttagatatgtctattgcgtgttacgacatgaaaaagagcatgatgaagaaggatggagtcgattttgtatccaacacgagatggttagaatggatgataggggattcgatggacgtgcaacctctgagagttcaactgaaagaagatcacagtacaatacaatacgggatgttctcaaacacgttacacatcgattcgaggaaagcggataccacgtcatatcatacgattgctgtagaatcaaaaggggagcgtgggtgttgtcacgttcacacggcaatttggaatcacatggtacgtaaccacttgtttaacgccgttcaagaggcgtgctacgtgtttaaaccgacgtatgatttaatagtgattggtgaaaagcaaaatcgtgaggatgaatttaggattggcgaacataatttttacaccataacacggaatcaccacatgcgtttaggcgataacgcgtataatcaattcatgaagggtttggttcagttgcgcgtggcgggagtgacaccgaacgcgatacgagaggaaatggccgctttagacgcgataagagatacttggataggagggaacttcgagcgaacacacatcaagtcccttgaaatatgtaagttattatctagcattggaagaaagatggttaacatggaggaagaaccaaaggatgaaagagacttatcagttaagtttcaatttaaactcgacgacaaattttcaacaaccgatccagaaagaaacgttatttttacacacaaaacacaccgtacgaatcaagatcgtttttatgtgtcgctaatgattgcggcgtcggacacaaataatggcagagtatggtggtcaaacccttatccatgtttacgtggcgcgttaatcgcgtctgaatgcaagctcggtgacgtgtaccataaattacgggcgtggtatgagtggagcgtaagacctgaatataaaccgcgagatttggagcgagaacaagaaaaatacatcgtcgggcgcgttaacctctttgacttagaaggagagcctgcaacgaaggtatttcactgggagtacgaattgattaataaagtgtatcagataacaaatcatacgggaaatcattgtgatttgtatcctgatgatgtagaaatcacggctaaatttgatgaggagaaatacggagagatgattcaaatgataatcaacgaaggatggaaacacggtgactttaagatgtttaagattctgaaggaggagggtaaccccttactatatgatctagagaaggacattaggttagatagtagatcacaagttatatttccaccatattttaacaaatggacgcacgctccaatgtttaatgcaaaagtgaaaccatgcgaagtcgagttagcgcaacgaaagaatgaagacccttacgtaaagcgaacggttaagcctatacgtgcggattgtatcgatctgttgaggtatcacatgtcgcattacatggatgtgagagtgtcaatgaaggggcttagtttagcagttaaacagacgccatccagtattcatcaagaatgggcgaaggatccattatatccaggttttctgcagaggagagatgaaaatttagatcataagtcggtatgtccgatcgtcacaaactatttctggttagagaggttctatactttagttttaactataatggaaaagcattattgggatttagacgatagtgatgttacgtatgagttccccacattggatgattcagcttacaagattgagggaacgttgtatgatgtctcgcaggtggtggttcatatgattgatagattttttgagaagaggcgtttcttacgctcagtcgatgagtgcaggtggatattgcatttaataaggtccacccgaagtcgggacaggctgagcgtttttaaacgctttttcccaacctttggtgagggactgtgtgtgaacaactttcgtaaagtgaaagatattatgctattaaatttcctgccttttttctttttaatcggcgacaatatggcgtatgaacatagacagtgggcggtgcctttgctcttctacgcagataaaataagggtcatacccgctgaggtgggcgcttattataatcgtttcggattggtgagcatcttagagctgctaacattctttccctcgtatgaaatgcgtgataataaggttgaggaggatgtgcacgcgtgtgcgagcgcgatcctggatttctatctaacgacaactatttcaaatggaggtatacaggctagcatagtttcaactaaggcgttactttatgagacgtatctatcctcggtgtgtggcggtttttctgaggcgattctgtggtacctcccgattacccatccagttaagtgtttagttgcgcttgaggtgtcggactcgctagtagactcaaatgtacgtatcgacaaaatcaaacgaagatttcccttatcccatagacatttacgaggcattgtccagatctctgtacggccagatcgcaccttcggcgtgacgacgtgtggtattgtaaagcataaaatatgtaaaaagactctgctgaagcagcggtgtgatgtaattttaatccagatcccgggttacgttttcggtaatgatgaattactcacgaagcttctaaatatttaatcccgtgacagggattgggcacgtttacacttac

SEQ ID NO: 112 - DNA, 1637 bp, artificial sequence
  VP5 DNA of BTV16 AJ586719
gttaaaaagatccctacgattgcggaagatgggtaaaatcatcaaatcactaagccgtttcggcaagaaggttgggaacgcgttaacgtctaatacagcgaagaaaatctatagcaccatagggaaggcggcggaaaggttcgcggagagtgagattgggtccgcggcaattgatggactagttcaaggtagcgttcactcaatcatgaccggggagtcatatggcgaatcggtgaaacaagctgtgctgctgaacgttctgggggcgggggacgagattcctgatccgttaagcccaggggaacgcggcatccagatgaagatcaaggagattgaagaagagcagagaaacgaattggtaaggctgaagcatgggaaggagattacaaagaaatttggtgaagaactagaggagatatatcaatttatgaatggtgaggtgaaggatgaggaagagcaggaagagcaatataaagtgctatgtaaggcggttaactcgtacgagaaattacttatagctgaaaatgacaagatgcacatattagctcgtgcattacagagggaggcagctgaaaggactgaagctgaatcaacaatggttaaagagtacaggcagaaaattgatgcactaaaggccgccatcgaaatcgaacgggatgggatgcaggaggaagcgattcaagaaattgctggaatgacagcggatgtgttggaagcggcttcagaggaagtacctttagttggttcggggatggcgaccgcgattgcaacaggaagagcgatcgagggcgcgtataaactaaaaaaggtgataaacgcattaagtggaattgatttatctcatttgcgtacaccgaagatagaacctacgatggttgcgactacgttggaacatagatttgaagatataccagacaaaaaacttgctatgagcattctagccaaaaataacgcgataacggcaaacacgagagagatccagcatattaaagaggagattttaccaaagttcaagaaggtaatggatgaagaaaaagagcttgaaggaattgatgataagaagatccacccaagagtaatgatgaggttcaaagtgccacggtcgcaacagccgcaaatacacatatatagtgcaccatgggactcagatgatgttttcttctttcattgtatttcacatttccatgccaatgaatctttcttcttaggttttgatttaggaatcgatgtagttcattttgaggatttggcggcccattggcacgctttaggcgcggcgcaggaagctaaaggacgtaccttgaacgaagcatatcgcgaattcttaaatttagcaatcggtagtacctatacttctccaatgcacgcccgacgtatgattcgatcgaaaacggtacatccaatctatttaggatcgatgcattatgatataacgtacgatactttgaagtcgaatgcgcagaggattgtatatgatgatgagttgcaaatgcacatattaaggggtccgttgcatttccaacggcgcgcaatactgggcgcgttaaagtttggagttaaggttcttggtgataaaattgatgtcccgctcttcctaaaaaacgcgtgactgcggtaatctcgggacttacacttac

SEQ ID NO: 113 - DNA, 2923 bp, artificial sequence
  VP2 DNA of BTV17 AJ585138
gttaaaagagtgatccaccatggaggagttcgtcattccagtctattcagaagatgagattccatatgcgttactaagcagataccctctggcgatacagacaaatgttaaaatagaggatgttgaaggaaaacataatgttgtaaagattcctgaatccgatatgatagatataccaaaattaacgattgtagaggcgatgaattataaaccagcgagaaacgatgggatcgttgtacctagattacttgatataacattacgcgcttatgatgatagaaaatcgacgaaaagcgctcgagggatagagttcatgacgaacgctagatggatgaaatgggccatagatgatagaatggatatccaacctcttaaagtgactttagatcattattgttccgtcaaccatcaactctttaactgcgttgttaaagcgaatgctgccaacgctgatacgatctattatgattatttcccgcttgaggactataaaaagagatgtaaccatacaaatcttgatttattgagaagtttaacgaatatggagttgttccacgcgttgcaaggtgctgcgtacagtatcaaatcaagctacgaattagtggcatactccgaaagaggaagcctggaggagacttatgtggtaggacagccaaaatggatacacttgactagaggaacgcgaataggcaatagtggattatcctatgaacggttcatttcgagcatggtccaggtaagcgtaaatggaaagattccagacgagatagcgaacgagatcgcgcaactgaatagaataagggcagagtggataacagccacatacgatagaggcaggattagagcgctagagctatgcaatatcctttccacgattgggcgtaagatgctaaatacgcatgaggagccgaaagatgaaatggacctatcgacgagatttcagtttaaacttgatgagaaatttaacagagcggattcagaacatgttaatatttttggtgtaagaggtccagcaacagatgaaggaagattctacgctctgatcgcaatcgcagcgacagatacacaaaagggcagagtgtggagaacgaatccgtatccatgcttgcggggtgctttagttgcagctgagtgtgaattaggtgatgtttacagtacacttcgacgtgtgtatagatggagtctaaggccagaatatggacagcacgagcgacagttagagaacaataaatacgtctttaatcgtataaatttatttgattcaaacttagcagttggtgaccagattattcattggcgttatgaggttaaagcatcggcggagacgacctatgacagcggatatatgtgtcggcatgaagctgaggaggatgaactattatgtaaaattaatgaggacaaatataaagaaatgctggacagaatgattcagggtgggtgggatcaggaaagatttaaacttcataacatactgacggacccaaacttattgacgattgattttgaaaaagacgcgtatctgaattcacggtccgagttagttttgccggattatttcgacaaatggatcagttcaccaatgtttaacgcgcgcttaagaattactaaaggggagatcggaacatcaaaaaaggatgacccatggaacaaccgcgcggtacgtggatacattaagtcccctgcggagtcgttagattttgttctcgggccctactacgatctgcggcttctattttttggcgagacgttgagcttaaaacaggaacagtccgcggtttttcaatatttgagtcagctcgatgattttcccgcgcttacgcagctaacaggagatgccgtatgcccacattcaggcggagcgttatatacgtttaggaaagtcgcgctatttttgatcgggaattatgaaaagttaagtccggatctacatgaaggtatggaacaccagagatatgtgcatccgtcgactggcgggacgtatcagaaacgcgtgctagagatgaaggatccctgccagcttacgtgttttgtgattgattacatctttgaaaaacgtgaacagctacgtgataccaaagaggcgaggtacattgtgtatctaattcaaagtcttactgggacacaacggctgagtgttttaaggtcgacgtttccgaatttcttccaacgattgttgatgctaaaagagatcaaatttgtgcgcgatctgaatgtgattaacttcctccctctgatgttccttgttcatgataacatctcgtattggcatagacagtggtcgattccaatggtactgtttgacgatacgatcaagttaatacctgtagaggttggtgcatatgcgaatagatttgggttcaaaagttttatgaactttacacggtttcaccctggtgagttgaagaaaaaacagattgccgaagatatacataaagagtttggtgtggtcgctttcgaatattacaccaatacaaaaatttcccaggggaatgtgcatacaccagtaatgactacgaaaatggatgtattgagagtacatttatcttctttatgtgcaggtctggcggactcagtcgtatatacattaccagttgcgcatcctaaaaaatgcatcgttctaataattgtgggagacgacaaattggaaccgcatacgcgttcagaacagatagttagtcggtataattactcacgtaagcacatttgtggaattgtatccgtcactatcgggcagaacagtcagttgagagttcatacatctggaattgtaaaacaccgtgtatgcgacaagttcattctaaaacacaagtgcaaggtgatattagtgaggatgccggggtacgttttcggaaatgatgaattaatgacgaaactattgaatgtctaggtcctatgacacggaccgatggcctcttacacttac

SEQ ID NO: 114 - DNA, 1638 bp, artificial sequence
  VP5 DNA of BTV17 AJ586720
gttaaaaagtgttctcctactcgcagaagatggggaagataattaaatcgctaagtagatttgggaagaaggttggaaatgcattgacgtcaaacacagcgaagaagatttattcaaccattgggaaagcagcggaacgatttgctgaaagcgaaatcggtgcggcaacaatagacggtttggtgcagggcagtgtccattccataattacaggtgaatcgtatggagagtcagttaaacaagcagttcttctcaacgtgttaggtacaggtgaagagttaccagaccctctgagccccggcgaacgtggtatccaaacgaaaataaaggaattagaagatgagcagcgaaatgaacttgttcgattgaagtataacaaagagataacaaaggagtttgggaaggagttagaggaagtctacgacttcatgaatggcgaggcgaaggaggaggaagtggttcaggaacaatactcaatgttatgcaaagcagtggattcttacgagaaaatattaaaggcagaggactcgaaaatggcaatgttggcacgcgcactgcagcgggaggcttcagagagaagtcaggacgagatcaaaatggtaaaggagtacagacagaagattgatgcgcttaaaaatgcgatcgagattgaacgagacggaatgcaggaggaggcgatccaggagattgctggaatgaccgctgacgtcttagaagcggcttcggaggaggtgcccttaatcggcgcaggtatggccactgctgtagcaaccggcagggcaatagaaggcgcatataaattgaagaaagttataaatgcgttaagtggaatcgatttgtcgcatatgaggagtccaaagattgaaccaactattatcgctacaacattggagcaccgatttaaagagataccagatgagcagctagcagtaagtgtgttgaataagaagacagccgtaaccgataactgcaatgaaatcgcgcatattaaacaagaaatattaccaaagtttaagcagattatggatgaggagaaggagattgaaggaatagaggacaaagtgattcatccgcgggtgatgatgaggttcaagattcctagaacgcagcagccgcaaatccacatttatgcggctccgtgggattctgatgacgtgtttttctttcattgcgtttcacaccatcatcggaatgaatccttcttcttgggatttgatttaggaatcgatgtcgttcactttgaagacttaaccagccattggcacgcattagggttagcgcaagaggcgagcgggcgtacgttaacggaggcgtatcgtgaatttctcaatctatcaatttcaagcacgtatagtagtgcgatacatgcgagacgcatgatcaggtcacgagcagtacatccgatctttttaggatcaatgcactacgatattacatatgaagctttaaagaataatgcgcagagaatagtctatgatgaggaactgcaaatgcatattctaaggggacctttgcactttcaacgccgagccattctgggagcgctgaaatttggagttaaaatattaggcgataaaattgatgttcccctcttcttacgaaatgcatgaacgcagcgagggagatgcttacacttac

SEQ ID NO: 115 - DNA, 2927 bp, artificial sequence
  VP2 DNA of BTV18 AJ585139
gttaaaatagcgtcgtgatggatgagttggcaattccaatctacacagatacgtttccggcgggtctattagatggatatgattatatcatagatgtgagtactcgtgtagatgagcctaaggggcgtcacgatgtaactgagattcctaaaagatcgatgtttgatattaaggatgaacctatacgtgaagctatcatatacaaaccagtcagtaacgatggatgcgtcttgccgagagtgcttgatatcactttaagagcatttgatgataggaagagggttattacgaatgaaggccacagcgaatttcacacgagatcaaattggttgcagtggatgatagatgatgctatggattatcaaccacttaaggtcgacgtagagcatgtaccatcacggataagccacgccctatccaatagcacggtaaggttacacgcaaagagagcggatactgcgtcttatcatatagagccagttgaagtggaggcgtatgggtgcaatcacgtgtggaccgaaagaatccatcacttagtaaatattgaaatgttccacagttcgcaggaggccgcttatatattgaagcctacatatcaaataattgcacacgccgaacgcgcggcggtgggagatgcgtttaatggtaggacgctcgagttgaatcggaatcatcgcatacagttgggggatcaaggatatgtgaaactcaagaaaggatgggtccagactagaatagaggggaagaaacccgcagctattgagagagaaatagcatctctgaatgaaattagagcgcagtggatagctagaggccatgaccgacgagaaatcaaggcattagacttgtgcaggattttgtccgcaattggaagaaagatgtataatatagaggaagaaccaaaaaatgaagcagacatgtcggtaaagtttcagatggagttggacgaaatttttaaacctggtaatagcgaacacgacaacatcatgggtggtggcacgcacaggaaggacgaagataggttttatgtgttaattgttatcgctgcgtcggatacaaatcagggacgagtttggtggagtaatccatatccgtgcttacgtggagcgctcattgctgcagaggtgcaattaggtgatgtttacagtacattaaggagttggtatcagtggagtatcagacccgcgtatgttccatacgatagaagcagagaaaatgataagtatatctatacccgaactaatttgttcgattccgctttgggacctggtgataaaataatacattgggaatatcagcttcttaatgaaacgcgagaggtcagcatgagtagcggtaacgaatgcgatttgttcccagaagatgaggaattcaccacgaagttcaatgaagagaggtatacagagatgaaaggtcagatcatccaaagtgggtggaaccatcgagattttaaaatgcataaaatacttgaggatggtgcaaacgtgttaacaatcgattttgaaaaagatgctcgtgtagggactgggtctgtgttgacattaccagattattatgataagtggatcgtggcacccatgtttaatgcgaagctgcggatcacagaaaccgttatcgcgaatgctcattcggatgatccagcgattgagcgcagcgtgaagccatttgatcatgacccatcaacgttacaaagattttgtttggctagatattacgatataagacctggattaagagggcgagcgctgctcaaacagcaggatgggtcaactataacaaagaaggtttcggcactggatgattatcaggatgttgtttcccgacgcgtgaactatgttcagcgtgatgtgaggtgccctacggagacagcacagtatgttttagagaaaacatcgctatatctattagcattgtttgataaacatgtgatgccgtccgcggagtcagaagctaagtttgtgcacccttcaatcgatgttaagcacgatatcgagacgtggcgcatcgctgatatttcgcaattgattgttttgattttcgattatctctttgagagtcgcaaggtggtgagggatgctgtggaggcgagatggattctttataaaataagatcatcaacgggacgcgcgaggatggaggtgatcgaaacgacattcccacgatttggactaactgtaaagaatatcacaaaggcgaaagtgaatcaagatattgcgtgtttaaatttctttcctcttttcttcatcgtcggtgacaatatggcgtatgctcaccgccagtggagcatacctatattactgtacgctcatgacattcgcataatacctctcgaggttggggcatatagtaatcgctttggactcacgtcttatttggaatatatgattttcttcccatcctacgcaacgcggatggctatgatcgatgaggctaataaagagtgtgcggctgcgttgctcgactattatctgagtacggatgtgcatcgtggaggagtcatgacaagtgttatcacgacgaaacgtctactgtatgagacgtacctatcctcgttgtgcggagggtactctgacggtttgttatggtatattccgataacacatccgctgaaatgtttggtggcgtttgaagtcgctgatgacgttgttccagctactgttaggaaggaaaggattctaatgcgatttccgttaagtgctaggcatctaagggggatagcgttgataacgattgatcgggatcgcaaggtacatgtacagacggagggtatagtatcgcatagactttgtaaaaagaatttacttaaatacgtatgtgatgtcattcttttcaagttttccggttatgtatttgggaacgatgagatgctgacgaagttgctcaacgtttagctctcgtgactgggagcgcacgcgctatcgacttac

SEQ ID NO: 116 - DNA, 1637 bp, artificial sequence
  VP5 DNA of BTV18 AJ586721
gttaaaaaagcgatcgctttcgcgaagatggggaaaatcataaagtccctaagccgattcggaaagaaagttgggaacgccttaacatcaaacacagcaaaaaagatttatagcacaattgggaaagcggctgaacgatttgcagagagcgaaattggctcagcggctattgatgggttagttcaggggagcgtacattcgttgatgacgggagagtcttacggcgagtcggtaaaacaggctgtgctattaaatgtaatgggaagtggtgaagagcttccagatccactaagcccgggtgaacgtggaatgcagacgaagatccgtgagttggaggatgaacagcgcaatgagttgattcggttgaagtataatgataagataaagcaaaaatttggaaaagaattagaagaggtatatgagtttatgaatggggtcgcgaagcaggaggaagatgaagagaaacattatgatgttctcaaaaaagcggtaaactcgtacgataaaatcttaaccgaggaggaaaaacaaatgaggattttagcaacagcgttacagaaggaggtgaaggagcggacggggacggaggccgtcatggtaaaagagtatcgaaataagatcgacgcattaaaagaggctatagaggtagagcgtgatggaatgcaggaagaggcgattcaggagatagctggaatgacggcggatgtgttggaggcagcttcggaggaggtgccactaataggtgcaggaatggcgacagctgtagccacgggtagggctatcgagggagcttacaaattgaagaaggtcataaacgctctcagcggaatcgatttgacccacttaagaacaccgaagattgagcctacgatagtatcgactgtgctggatcataagtttaaggatattcccgatgaaatgctcgctgtaagtgttttatcaaagaatagagccatcgaagagaaccataaagagattatacatcttaagaacgagatattgcctagatttaagaaggcaatggacgaggagaaggagatatgtggaattgaagacaaaaagatacatccgaaagtcatgatgaaattcaaaattccgcgaactcaacagccccaaattcatatatatagtgcaccgtgggattctgacgacgttttcttcttccattgtatatcgcatcaccacgcgaatgaatcattttttattggattcgatttaggtatcgatctggttcactacgaagatttgactgctcattggcacgccttaggtgcggcgcaggcggcggttgggaggagtctgaacgaagtgtacaaagaatttttgaacttagcgattaataacacgtatagctcgcagatgcacgctcggaggatgatacggtcgaagactgtacaccccatatatttgggctcactccattatgatatttcgttttcgacattacggagcaatgcgcagagaattgtgtatgatgaggaattacagatgcacatattaagaggaccactacacttccaaaggcgggcgatactaggcgcgataaaacatggagttaaaatcttagggacggaggttgatatcccactcttcttaagaaatgcctgagcgcagcggagccaccgctttccacttac

SEQ ID NO: 117 - DNA, 2947 bp, artificial sequence
  VP2 DNA of BTV19 AJ585140
gttaaaaaggatttcgccacaatggatgagttcgcagtacctatagttcgtgggcgcacgataccgtatgacttgattagagcatatgagactattattgatctagatgttaaagtggaggagaatgaaggtaaacatgatatcacgaaaattccagaatcgtacatgtgtgatgtccctgatataccaatacaggatgctacaacagctactctgagtaggaacgatggctatgcgttgccgcgcattctggatgtgtctatcgctgcttacgatacgcggaaaggttatcaaaaatataatggtatagaaaggatgacaaatcaggtgtggttaaagtgggctataaaggattttatggatgtgcagccgctgaaggttagtttaacagacgctgaaggaaaggttagatatgatttatttaactgctcagtgcggatggatgcgaaaaaagctgaagcagtatactatgggtgggccgcgcaggaggttatcgataagggatgtaaccatgcaagaagtgaattacttcagcatgtcatcaggtgtgaactgtcaaactgtgctcaagaaagcgcgtatatgctcaagcctacgcagaagttggagcctgttgcagagaaaacatcgcttagtgagaggctgctgccgggatcgagtcatctaactagtatgcggcgtggtgaggtgttcaggatgggtacagagcagtataataggatggtgcagggtatggtatcgagtcaaggggtaaaaggccacacacctggtaaaacaagaattcaagatgaaatgaatgagttaatgaaaataagagatcgttggaaggttgcgagagaccggagagagatcaaatcacttgagttatgcaaactattatcgtcagtcgggaggaagatgtacgacaagtacgaggagccgaaggatgaagaagctatgtcgttgaggtttcagtggaatctcgatgaaattttcaagaccgataatcgggagcacataaatattgcggttgaaaagagcgggaggactaatgatgaaagattctttgcattgatcatgattgcagcgacagatacgaatcgagggaggatctggtggtcgaacatgtttccgtgtttgcgaggcgctctgatagtaggagagacgcagtctggcgacgtgtataaaatgttacgtgttcgattcgactggagtgttcgcaatgagtacagtacgcaggctgatgtcgcacggcagaatgacaactatacgtttacgcgcgttaatctatttgatttgatttctgaaccagcaacccctgtgatacattgggagtatgacctggatgcaccacgaaaaacaaattatttagatggacatgcatgcgatgagttcccggatgattatgatttagtatgctcgtttgatgaaactaagtatagcgaaatgattcagagaatcctagacggtggatgggatcataaaaactttaagtattataagattctgaaagatgcggggaatgtactcacgattgattttgagaaagatgcgaggcttaatgaacattcggaaatggtaatgccatcatacttcaataagagaattgccgcgcctatgttccgatgtatcctgagaatatgtgaaacaacgatttccgtgagacaaaacgcggacccagctgtgtctaggaccatcaggccgcttaaagcgaaggctgctgatctactagattttaccctaggctcctactatgacacacgttttggcgtaatgggaaggacgttagtgatgtcacaaaaacagagcgaaatgtataaaatgattcaagaagcggaggattacagcgaactgatgaagtcgcggggtgtcatcgaaaagttcaaaaacccatgcccaattacgacagcctgtcaatataccttgcagaagacctcggtgttgatcctttcccgagctcagcgttatttcagagaatttcacggtggggaccaagaagaatacatgagtccaacattgaattttgagtggtccgatatgacatcaaatatctatgatgttgcgcaaatggttgtattagttttcgacgtactattcgagagaagacgcgttgtacgtggcgtagatgagtcgaggttcattttacatcagttaagaattagaaagggattaaatcgcttagattatgtgaaaatccactttccacacttgtatcaatggtggaaggcctcagaatctacgtatggagaggcgcagaaattaaacctgctgcctttgctctttctcgtaggggataacttcatctatgaacatcgccaatgggcgtaccctgcagtgttgatatcgcataaattacggtttattccggttgagctcggtgcgtactataataggtttggattgacttctttgatttcgcatctgactttccacgtggggaaagcgaagtatgatcaaaatctcgatcaagcggagcagaaggttttcagcgcgcttaaggattattatgcggaatcaactatcacagatgggggagttaacacgcactcgacgatgacaaaagatccgatataccaggtttacttatcgactatctgcggtggattgcttgattcacttgtctatctaatgcctatcacacaccctatcaaaagtatcgttgctatagttataaatgatggaaaaggctcggcgtcagattgcgttcgacgtgtgacgcggaaactcaggtatattcaacatcatatacgcggatccgttgtgatctcgattcttagtgatggctcaatcaacacgtattcagaggggattgcgaaagcgacactgtgcgataagagcgttctaaagtatagttataaggtggtactgattaaggttaaaggtcacgtatttggtcatgatgagatgctcacaaaactgctaaacgtgtgaggcttccgtgactgcaagcaggcgacattcaacttac

SEQ ID NO: 118 - DNA, 1637 bp, artificial sequence
  VP5 DNA of BTV19 AJ586722
gttaaaaagtgtcctcatcatcgcagagatgggcaagatcattaaatcattaagtagattcggaaagaaagtggggaacgttctgacgtcaaatacggcaaagaagatttacagtacgattgggagggcggcagagcgtttcgctgagagtgaggtgggtgcagccacgatagatggattcgttcagggaagcgttcactcgatcatgacgggcgagtcttatggtgaatcggtaaaacaagcagtactgcttaatgtgctaggcagtggtgaagagttacctgatcccctaagtccaggagaacgcgggatacagaccaaactaaaagagttggaggatgagcaacgcaatgagctggtccgtttgaaactgaataagaaaatagttgacaaattcggaactgaattggaggaggtttatgattttatgaacggggcggcgaaagatgatgagaatgaaattaaacaatacgatattttgtgtaaagctgtagactcatacggaaagatcttgcgagaggaagacaagaaaatgttggaattagcgagagcgttgcagcgtgagtcggagtcgagaagtgacgaggagaccaagatggtgcgggaatatcgttcgaaaatcgatgcgttacgcgatgcggttgacgttgaacgtgaaagcatgaccgaagaagcgatacaagaaatagcaggaatgacatcagatgtcctagaggcggcggcggaggaagttcccttggttgggtcgggaatggcgacggcaatagcgacgggacgcgcgattgaaggcgcgtataaattgaagaaggtaataaacgcactaagcggtattgacttgactcatttacgtacgccaaagatagaacccagcttaatcgctacaacattagagtatagagataggccaattccggatgactcactagcagtcagcgtactcgagaagaggagggcgatagaagaaaataaaaatgagatcgaacatattaaaaatgagattttaccccggtttaaaaaagcgatggaggaagagaaggagatttctggaatcgaggagtctgtgatacatcctaaagtgatgatgagattcaagatccccagatctcagcagcctcagattcacatttattgttcaccgtgggattcagacactgttttctttttccattgtgtatcacatcatcatatgaacgagtccttttttatcggtttcgacttagagctagatttagtgcattttgaagatttgactgcgcattggcacgctttaggcgccgcgcaaacggttgttggacgcacgttccaagaggcgtaccgagagtttttaggtcgtgcgatgatggatccttcaagcggagcgatgcataagagaagaatgtcacgatcccgtagtgtacatcccatttatcttgggtcgatgcattatgatatatcctacgctaccttgaagagtaacgcacagcggatagtttatgatgatgagttgcagatgcacgtgctgcgtgggccgatacactttcagcgcagggcaatcttaggtgcgcttaaacatggcattaaaatacttaatgataaaattgatctcacatctcttcttagaaatgcgtgaagcagcgacgacaggcgcttacacttac

SEQ ID NO: 119 - DNA, 2925 bp, artificial sequence
  VP2 DNA of BTV20 AJ585141
gttaaaagagcttcccacaatggaggaattcgtaatcccagtattctcggagcaggacatgccttatgctttgattaatcaatatccccttgcgatacgaactgatgttaaaataccagacgttgagggcatccatgatttagctaaaatacctgagtccgatatgatagatgtcccgaaattggatatagtaagcgctttaaactataaacctgtgaggaatgatggcattgtggtaccacggctattggatatcactctgaaagcttacgacgataggaagtcaacgaaggacgcgcaaggcattaaatttatgacgaatgccggttggatgaaatgggcgattgacgataggatggatatacagcctctgaaagtaaaattagaccaacattactcgatagattaccaactcttcaattgtgttgtgaaggctaaaacggcgaatgcggatacgatgtattacgactacttccctattgagaataaaacgaaaaaatgtaatcacacgaatttggatttgttgaggagtttgacagctgttgagatgtttcacgtactacagggggctgcctacaatttgaaagccaattatgaattaatcgcaaactcagaaagagaaagtctcgaggagagctatccaatcgggtcccagaaatgggtgcatttgactagaggaactaaaattggaaatagcggggtaccgtatgaaaggttcatctcaagcatggttcaggttgtggtaaagggtaaggttccagttgaaatcgtgagcgaagtggtgcggttgaatgagattagaactgagtggataaacgcagggttcgaccggagccgaattagagcattagagttatgcaacattttatccacgattggacgcaaaatgatggacacacaagaggaaccaaaagatgaaatggatctgtcaacgagatttcagttcaaactagatgataagttcaatacagcggattctgaatacatagttatatcaagagtaggaggggcggcgacaaacgaaggaagattttacgccctcattgccattgctgccacagatactcagagggggagggtctggaggacgaatccgtatccgtgtctacgcggtgcattgatagcggcggagtgtgaattaggtgatgtctactactctttacgtcacacttatcaatggagtctgcgcccggaatatgatcagcgagagagatcgctagaaaacaacaagtacgtgtttagtcgtataaaccttttcgattctaacctaacggtgggagacaaagtcatacactggcgatatgatctgactaagccaatggatacgacttttgatgacggctatatgtgtgtgtcgcatgaaatagatggtgagttactctgtagaattgacgacgacagatacaaggaaatgctggaaagaatgatacagggcggttgggaccaggagcggttcaagctccatagcatattgaccgaacctaacctattgactattgattttgaaaaagatgcctaccttaattcgcggtccgagttggtgatgccggattacttcgataaatggataaattcacccatgtttaatgcgcgattgcggctaacccatggagagattgcgtcgcgtaagactgacgacccgtggaacaaccgagtcgtgtttggatacatcaaaactacgactgagtcgttggactacatgctagggagatactatgatgtgcggctgcaattttatggtgatacattgagtcaggggcaacgtcaatcttctgtctttgcatacattagtcaacgagacgatttccagacgcttactcactacgtaaaggatgatgcaatatgtccgcatgctggagggtcgatttatactttccgtaaaaccgctttgatgctgatggctaattacgaaaaattaagcccggagcttcatgaaggattagaacatcaaacttatacgcatccttctgacggaatggattatagaaagtatgttgtagatatgaaagatctctcgcagttaatatgtttcgtgtttgattatatttttgagaaacgcgcacagttacgcgatcctaaggaggcgagacgaatcttgtatttggtccagaataatgtagggtctcagcggttgggagtattgagtagtgcattcccaaatctcgctaatcggttgttaaagctacgggagatacatttcatttacgatatgaatgttatcaatttcttacccctgttgtttcttgtccaagataatatttcatattggcatagacagtgggctatacctatggtactctttgacgaaaccatcaaactaattcctgttgaagttggcgcttatgcgaatcggtttggattcaagagcttctttaacttcacgcggttccacccaggcgattccaggaagaagcagattgctgacgacgtacataaggagtttggtacaatatgctacgaatattacatgaatactaggatgtcacaaggtggagtgaatatatcagtggtcactactaagttggatgtgctcaagatacacctcgcttcactatgcgcgggattagctgattcgattgtctacactttgccggtcgcacatccgaggaaatgtattgttctgatagtggttggtgatgacaaacttgaaccacagatccgcgcggaacaggttctcagcaaatattattattcgcgcaagcacgtgttgggcgttatctcaatcagcgttagccaagacggtaagttaaaagtttactcgtcgggcatcgttagacatcgcctctgtgagaaatctatattaaaatataaatgcaaaactatcttaattagaatgcctggacacgtttttgggaatgatgagcttatgacgaaattactcaatatttaggtccttgacacagacctgtggcctcttacacttac

SEQ ID NO: 120 - DNA, 1638 bp, artificial sequence
  VP5 DNA of BTV20 AJ586723
gttaaaaagtgctgtcctactcgcagaagatggggaagattataaaatcgctaagtaggtttggtaagaaggtaggtaacgcgctgacatcaaataccgcgaagaagatttactcaacgatcggaaaggcggcggaacgtttcgcggaaagtgagataggtgcggcggctattgatggactagtacagggaagtgttcattcaattatcacaggagaatcatatggtgaatccgtaaagcaggcggtactattgaatgtattgagcgcaggtgaagaactaccagaccccttgagtccgggtgaaaggggcatgcaagcgaaaattaaggagctagaggatgagcagcgaaatgaattaattcgattaaaatataataaggagataacggatgcgttcggaaaggagttgaatgaagtctatgaatttatgaatggcgaaacaaaagaggaagaagtcgtacaagagcagtactcgatgctatgtaaggcggttgattcatatgaaaaaatactaaaagctgaggactcaaaaatggctgtcttagcgcgcgctctacagcgagaggcttcggagagaagcgaggatgaaatcaaaatggtgaaagagtatagacataaaatagatgcgctgaagaatgcgattgaggtcgaacgtgacggaatgcaagaggaggcgatccaagaaatagcgggaatgactgccgacgttttagaggcggcgtcagaagaggtaccattggttggcgcgggcatggcgaccgccgttgctacgggaagagctatcgagggcgcgtataaattaaagaaagttataaatgcgttaagtgggattgatttatcacacatgaggaccccaaaaatcgagcctactatcatcgctacaacacttgagcatcgattcaaagacatacctgatgatcgattagctataagtgtgctgaacaagaaagctgcagttgccgataactgtaatgagatatctcatataaaacaggagattctaccaaaatttagaaaaattatggatgaagagaaagagatcgaagggattgaagacaaagttattcacccacgggtaatgatgaggtttaagatcccgagaacgcaacaaccacaaatccacatctatgctgctccctgggattccgacgaggttttcttcttccactgcgtgtcacatcaccaccgtaatgagtccttttttctgggttttgatttaggtatagacgtagtacattttgaggatcttaccagtcattggcatgcattaggaaatgcgcaagaggcaacaggacgtacgcttacggaagcatatagggaattcttaaatttgtctgcgacgagtatgttcagcagcgtaatacatacgagacgtatgataagatcgagagcagttcaccctatatttcttggctcgatgcactatgatgttacgtacgaggttcttaagaacaacgctcagcgtatcgtttatgatgatgagctacagatgcatattctgagaggaccattgcattttcaacgtcgagctatattgggggcgttgaagtttggtgtgaagattcttggcgataaattggatgttcccctcttcttacgaaatgcatgaacgcagcgggggaagcgcttccacttac

SEQ ID NO: 121 - DNA, 2922 bp, artificial sequence
  VP2 DNA of BTV21 AJ585142
gttaaattagtctcgtgatggatgagttagcgatacctatcattgatggtcgattcccgaaggaggcattattggaatattgttgtatagttgagctaaatccagcgagtgaggaagatgatgtggatgtgacaacgataccgcagaaggatatggtggatataccggacgcgccaatacgcgaagctctgaactacttacccaagaggaacaatggccacgtattaacacgcgttgtggatatatcattgagcgggtacgatagacgaaaataccatcggactagcacaggtggagatttcttgtctcccgaggaatggctgaactggatgatccgagattcggtggatgtgcagcctctaaaagcgagcttagaatttccgtcaaagattaaacatagtttatttagttccaacgtgtatgtgtcagttaagaaagcggacaccatatcgtatcacatagaagcgaaggaagttgaaacgagggcgtgtgaccacgcgcgtgtagcaatgtggaacaatcttgtgagacatgagatgatgcatagtgcgcaggagccagcatacattctgaaacccacgctcgacataatcgtgcattcagagagggcatcgacggatgttccattcgaactagtcggtcaacgctatatctcgattgggaaaaaccatcgaatagttctaggagatgatgcctatcgaaagacattagacggacttacaaggttgcgtgtacaagggcgaattcctgagttaatacgaaatgagatacaacaacttcaccagataagggatgcgtggataaccgattcgtacaacccacgacacatacgatcgttagaactgtgtagaatcttatcgcatataggaaggaaaatggtgcatatagaggaggaacctaaagatgaaagtgatttatcggttaaattccagtttaagttagatgaaaaatttagaattaatgatgatgagcgtaacgtgatattcacatcaaagggtcaaaggaatgatcagcagcggttcttcgtattaatcatgattgcggcatcagatacctacaatagccgtatctggtggacaaacccatacccatgcctacgtggcgccttgatcgcctcagaaacctcacttggggatgtgtattggacgttgagacatttctatgattggagcgtcagaccggtatattcaccgagacaaaaggagcgagaagacgataaatacttatatggtagagtcaatctatttgatcttgatgccgatccaggtacacagattatacattgggaatataagcctattacaagtacggtgaaaactacgtatgagagaggcaatatgtgtgatttatttcctgatgtagacggcattacgactaaattcaataaaacggcttacattgatatgattagcgaattgttaaatggtggctggaatacacgcgaatttaaaatgtataaaatacttgaaagcgtagggaacgttttgacaatcgattttgagaaagatacgaagcttaactcaagatctgaactttcattaccgtactactatgataaatggatatacgctccaatgtttaatgccagattaaagataacgcaaacagagatcgctcaacgtaaagcagatgacccgagtatatatcgtaccttagcgccaattagttcggaccctatcgatttacagcgcatgtgtttagctaattactatgacgtaagaccggccatgcatggacgtgcgctttctaaaagacaagaacaatccgcttatcacaaaaatttagcgaacctagccgattatcaggatattttaaaacgtagaggataccgtaaagttgagaacccatgtccgctgatcacgtgctcgtatattttggaaaaatctgcattactttggattgatattatggagaaacacgtaggctacgcgccggagagcgagatagagtttgattttccgaaagtgaacacgtctactcgaatcggtactgagagaatcgttgatatatcacagctagtcgtacttatgattgattggctttacgagaaacgccaaactacgcgaagtgtggatgaagcgcgatggaccgtacaagtaattcgacgcgttactgggaagaagaggctggaggcgatcagtcgcgagtttcccaattttggagaagcggtctcgcgccttgcatgtcccaaaactgttagagatgtaatggtaatcaattttttgcctttcctcttcttattaggtgataatatggcgtacgaacataggcagtggtcggttccgattatattatatgctgataccttatggttccttcctgtggaggtaggagcgtattacaatcgttttggaatcgtatcgtttttagaatatttaaccttcttcccgtctaatcacatgagaacagtagcgttggatgaagcggaatctaaggtggggaagttgatattagaattttacttgaataccactatttatcttgggaacattcagcaaagtgtaatctcgacgaaacaaattttatatgaaacttatctgtcttcgctgtgtggaggctttactgagggattagtttggtacctcccaataacgcatccgcaaaaatgtgtagttgccattgaaatttgcgatgaccgagtcagcgcgggttacaggtgtgataagctacgatcgaggtttccgctcagtctggatcacttacgaggtatcgtgatactgtccgtttccaagagtagggcgattagcgcgtactcagaggggatcgtttcgcaccgattgtgtaagaaaaacgttttgggtttcacgtgtagagttttgctactgaaattctctggtcacgtatttgggaacgatgagatgctaactaaattgctaaacgtttagccctagtgacatagggtgcacggactaatcaacttac

SEQ ID NO: 122 - DNA, 1637 bp, artificial sequence
  VP5 DNA of BTV21 AJ586724
gttaaaaagatccctatgattgcggaagatgggtaaaattatcaaatcactaagccgtttcggcaagaaggttgggaacgcgttaacgtctaacacagcgaagaaaatctatagtaccatagggaaggcggcggaaaggttcgcggagagtgaaattggatctgcggcgattgacggaatagttcaaggtagcgttcactcaatcatgactggggagtcatacggcgaatcagtgaaacaagccgtgctactgaacgttctgggggcaggggatgagattccagatccgttaagcccaggggaacgtggcatccagatgaagatcaaggagattgaagaagagcagagaaatgaattggtaagactaaaatatgggaaagagattacaaagaaatttggtgaagaattagaggagatatatcaatttatgaatggcgaagtgaaggacgaggaggagcaggaggagcagtataaagtactatgtaaggcggtgaactcatatgagaaattacttatagctgagaatgataaaatgcgcatactggcgcgtgcattacagagggaggcggcagaaagaactgaagctgagtcaacaatggttaaggaatacagacagaaaattgatgcactaaaagctgccattgagatcgaacgggatgggatgcaggaagaagcgattcaagagattgctgggatgacggcagatgtgttagaggcggcttcggaagaggtacctttagtcggctcggggatggcaactgcaattgcaacaggaagagcaattgagggcgcatataaattgaaaaaggtgataaatgcgttaagtggaattgatttatctcatctacgtacaccaaagatagaacctacgatggttgcgactacactggaacatagatttgaagacataccagataaaaaactcgctatgagcattctagccaaaaataacgcgataacggctaacacgagagagatccagcatatcaaagaggagattttaccaaagttcaagaaagtaatggatgaagaaaaagagcttgaaggtattgacgataagaagatccacccgagagtgatgatgaggttcaaagtgccacggtcgcaacaaccacaaatacacatatatagtgcgccatgggattcagatgatgtcttctttttccactgtgtctcacacttccacgccaatgaatctttcttcttaggttttgatttagggatcgatgtagttcattttgaggatctggcggcccattggcacgctttaggtgcggcgcaggaagctaaagggcgtaccttgaacgaagcatatcgcgaattcttaaatttagcaatcggtagtacctatacctctccaatgcacgcccgacgcatgatccgatcgaaaacggtatatccaatctatttaggatcaatgcattatgatataacatacgatactttgaagtcgaatgcgcagaggattgtgtatgatgacgagttgcaaatgcatatattaaggggtccgctgcatttccaaagacgcgcaatactaggcgcgttaaagtttggggtaaaggttcttggtgataagattgatgtcccgctcttcctaaaaaacgcgtgactgcggtaatctcgggactttcacttac

SEQ ID NO: 123 - DNA, 2907 bp, artificial sequence
  VP2 DNA of BTV22 AJ585143
gttaaaagttgccaggatggaagatttcccgatttgtgcaatagagcgcgaatccgtatatgatgaggattttataatgagataccctgtcattgtggacctaaaggagtgtgtggcggatagaagaaacaaaaccgatgtgtcaaagttagaagaaattaaaggcgtatgtgtgcggtcggaaggcgtacgcgtagcgttgacatcaagaccagaccctttatcacatgttatcacgccatccgcacttaacgtgctaatccaagcgtatgatcgtaagcataaagtatcgctaaggaagcgcttcgaagatggtgagggggtgaccgagtatgatttggacacgtgggtcaagaaacgattggaggagcaagcggacttacaagcggtataccacaccatagatgcaaaccgagggaaattgaaatttaaaacattgatgggaacgatcagattggattccaactatgctgaaactgtagggtatgactacgcgccagtttcgaaggctggttgtaaccacgggaatgaggatccgttgtatgatttcattctgtcaggagcgttccaggtatcgaagacagcaggatacacgttaaaacaaacatataggctgactgtgcgtacagaggttcgtgaaaataacaaaaatgagttggtcgtcaacgaaatttatactcccggtatcgtacgcggcgaacagataagagatatgacgagtgttgcatatatgaggttccgcgatggatggatacgagcgatcattcagccgcagatagtagaagagctgagagcgagcaaggacgcgttggataggatatcaaatgaatggtatagcagtcgaaatacgccagatgttgttgaaatatgtcgaattgtttcatcgataggtcgccggatgtggaacagtgaagagacgcccgttgacgacgctatgaggtcgagggtttttcaagagaagttgcgactattattccgagtcggaaatagtgaatatgatacgattcaatcgatctcaagcggccaaacagatctaaagaagttctatgcgctattagcgatagcggcgaccgacagttatcggtggcgtatctggtggagtaatccttatccatgcttgcggggaactataatagcatgtgaaatggaattgggagatgtttacaagactttgagatctacgttccgatggagcttgcgaccagagtacgcgaatagatccgagattgatcgagagaagaaggcgtacccatatcagaggataaatttatttgaatcaaaattgaccccagggacgcgcattattaattggctggtcactcgagtgccacttgaaaaaccggacattagtacgggacgcgtttgtatgacgtcaactgaatccaattatattttgaaaatcgatgatgcgaggtataagcagatgataagtcagatcattgaaagaggttgggaaaaagaacagttgaaatttgaaaagatagttcaagatgatggaaacgtattcaaaatggaatttgaaaaagacgcttgcatggatgaaaagagtcaccttgttatgccatattattatgataaggaaattcattgcccgatatatcatcaaaaaattaagatcacagaggcgcagatggcaaatgagtggagtgacgacccatgggtgaatagggtcgtaagcggatatttgggcgaccatgttgaaacatatggtttagggtacaaccatatttttgatacacgcgtaccattgaagggtaacttattggaacaagagcaagagatttccagctatcatgagcatctgcgctcagatgaatcaaaggaggatgacactcattgcgcgctgcgaatcttttcagataaagctatccgtatgttgtttatagctatatataagaaattgattcatcacatccctaaggaagaatatgctacacgcgaggaagagctgattcagtacatttctatggttgagagggttcgatcatgggatcaattcattgtattcatctttgatttcttctttgaaaacagaaaagggatcaggacaatggaggaggcaacacagttggcaaaatctatacgtggtagcgtaggcgcgatgcgatggacgatattttcgagttcatttccaactagttacagactaatgaaacaaattttggtggcgaagaggtggggtgactgctacattatgaattttttaccgctgttgatatgcggtggtacttccattagctacttacaccgtgaatggagttatcccatgatagttacgtttgaagacgggatcaagattgtgccgacaatggttggacgatcactaccgcagggatctttgggagagtgggtatcttttataagcttttttatggggactgtgcacgagaaaatcaaagttgaagaagatgagctagaagtcctgcggcggtgcgtggaattttacagagatgtgaagatggtcgatgtaattaaggacactccagtgcgaatgacgaagtacataacatgtgatctcgcgtttggtagcggttgcggcggtataagtgaatctattagttttatattaccggtcacgcatccgaatcggagtttagttgtctttgtgatctcggatgataagttatctccatcccaacatgcggcgagggctaaacgtaggtttaaaggtacatgccagtatatagatgatgttattgttcttcaaatgaagcggcccggattggttgggagtgtttggagcgagaagcacagcaaaatcaaagtctgcaggcgtaattttttaaattatgatcataaggttatattaacgaaattcgcaggtttagtttacgggaactacgagctgctcactaaactggctaatctgtgagcctgtgacacggctccctagcaacttcaacttac

SEQ ID NO: 124 - DNA, 1645 bp, artificial sequence
  VP5 DNA of BTV22 AJ586725
gttaaaaagcagccaccaaacattgcatgatggggaagatcatcaagtcgttgggcaaatttggcaaaaaagtcgggaacgcgttgacatcgaagacagcgcaaaaaatttataaaactatcggaaatgcagctgaaagattcgccgaaagtgagattggaagcgcggcgatcgacggattaatacagggaagtgtacattcaatcatgacaggagagtcgtatggcgagagtgtcaagcaggcggtgatattgaatgttttaggaggaggcgacacgatagctgacccgctgagcccaggtgagaatgaaatttatagaaagttgagacagctcgaggaggaacagaaaggtgaagtagtgagaacaaaacataacacggagatattggataagttcggaagggatctcgatgaggtttataagtttgcgacccaggagcataaggttggcgaagatgaggaggatcagattaaaatgctcgagaaggcgttgaagtcttatgtgggcgtctttaaggcggaaaatgagagcattaataaactcaaacaggctttgtacctcgaatcaacagaacgtacggatgaggagacgaaaatgattagcgaatatcgcgacaaaattgatgccctacggggggcgattgaggtcgagaaagaggggttacaggaggaagcaatccaagaaattgctggtatgagcgcggatgttttagaagcagcggcagaagaagtaccgttatttggagcgggtgttgctacgagcattgcgactgctcgcgcaattgaaggcgcgtacaaaattaaggctgtgataagcgctctgtctggaattgacttaacccatctgagtgtgcctaaggtccagcccaaaacgttggaagcgatcctagatactccaaaggggaaagacatatctgatttacgattgaccgaaggcttgatagcgaaaatggataagatatctgaaaatatctcagaggttgatcatatacagaacgtgattgttccgaaacttaaaaaagcagcagaggaggataaagaaaacataacaaattggtctgaaaaacgcattcatcccaaaacggtgcaacgttttaagataccacaggcccaaaggccttcaatgcatatatatgcggcgccctgggattcagatgaagtgtttatctttcacataatttcacctcatcataagaatgagtctttctttttagggttcgatttggaaattgaatacgttttttatgaggatctgactcagcactggcacgcgttgggggcggcgcaatcggcgtatggacgtactttccgcgaggcgtatagggaatttttcatgcttgcatcgaatgtggctggacaaggggcgattcatcaaaaaaggttattgaggtcgaggagtagtcatcctatctatttggggatgcatgattacgaagtttcatacgagcagatcaaaatgaacgcgatggcattggttagcaacgaagatttacagatgcatgtactgcgcggccctgtgcattttcagaggaggacgattgtggcggcactgaagtatgggattaaaatacttacccaaccggatgacgtttccgtcatgcttagaaacgcgtgaaggcgggtgtaggggctacttcaacttac

SEQ ID NO: 125 - DNA, 2927 bp, artificial sequence
  VP2 DNA of BTV23 AJ585144
gttaaaatagcgttgcgatggatgagttagcaattccaatatatactaatgtatttcccgcggagctgttagatggctatgattacattatcgacgtaagcacacgtatcgatgaacctgcgggacgtcatgacgttacacaaattccaaattcagcgatgtttgacgtacaaaatgagcacatccgagacgccatcatatctaaacctgttagcaatgacggatatgtgttgccacgaatactagacatttcgttgagagcgttcgacgatcggaaaagaataataacgagtggaggtcagagtgaatatcatacgaaagcggattggttacagtggatgatcgacgacgcgatggatgtgcagccgctcaaggtcgatactgcgcacacgagaacgcgagtgagccatgcgttatttaactgtacggttaggctgcatgcgaaaaaagcggatactgcttcgtatcatgttgagtccattgaaatcgagccgaatggttgcaatcatgcgtggattcaaagagtgcaccatttggtcaacatcgagatgcttcactgttctcaagaggttgcctatatgctgaagcccacatatgaaacgattgtccacgccgagcgcgcatccactagcgatacttttaacggaaggacgatagagctgagccgtggtcatcgcgtacaattgggagacgctgcgtacgagaaactgaagaacgggttggttcaaacacggatcgaagggaaaaaaccacaattggtcgaaggcgagataaattccctgaatgatataagacagagatggattaacagcggccacgatcgaagagagataaaagctctggaactttgtaagatcctgtccactatcggacgaaagatgctcaatacagaagaggagccaaagaacgaagcggatttatcagttaaatttcagatggagttggatgagatcttccgtcctggaaataacgaacgaacgaacatatttggagggggtaatcatagaaaggatgaggatagattttacgtgttaatcatgatagcggcttccgatacttataagggtcgtatatggtggagtaacccttacccatgtttacgcggatcattgatagccgctgaagctcagctcggagatgtttataatacaatgagaaattggtatcagtggagtgttaggccaacttataccccgtacgataggagcagagagagcgacaaatacgtatatagccgagtgaatctgtttgattcaacgcttagacctggcgataagattatacattgggagtataaattgctcaacgaagtacgagaggtgtgcataaaggatggtaatgaatgtgatctattccctgaagatgaagagatgaccaccaaatttaatgaggaaaaatatacagaaatgaagggccagatcattcaggatggatggaaccatcgagattttaaaatgcataaaatactgcaagatggtgctaacgttttgacaattgattttgaaaaagacgcacgtataggaaatggatcagttttgacgttacccgaatattataacaaatggatagttgccccaatgttcaatgcgaaattacgcatctctgagactgtaatcgcgaaagcacactcagatgaccctgccgtagctaggacagctaaatcgtttgatcatgaccccttcaacttacaacggtactgtttagcgagatattatgatgtacgaccaggattgatgggacgagcattatccaaagagcaggaagggtcagccatagcgaacaaagtggctgcgcttgaggattatcgggacgttatatcaaggcgtttagggtatgttgaacgtgaaaaacgatgtttaactgaaacggcgcagtatatattggagaaaacatcattgtatctgttaaacgtactgagtatgcacgttaaaccgactattgatatggatattaaatttaagcacccatcgattgatacacaccttgatattgatacctggaagatcgcggatatttctcaacttatagtattactatttgattatctgtttgaaagtcgtaaggagattagaagcgtgactgaagcgaggtggattttgtttaaggtcagatccgtttcgggacaagaaagactgaatatgattcaatctttctttccacggtttggacgagtcgttagagacatcgctaaagcgaaaatcactcaggatgttgcgcatcttaacttctttcccttattttttatcatcggcgacaacatggcttacgctcatagacagtggagcatacctgtcctattatacgctcatgacataagaataataccattagagattggtgcatataacaaccgatttggctttacatcctacttggagtatatgacgttctttccgtcacacgcgacacgagaggcggtacttgatgaatcaattaaagagtgttcgctcgcattaactaatttttatttgaataccgatatccatagtggagagatcatgcgcaacgtggtgacaacgaagcgcttgctatatgaaacacacttagcgtctttatgtggtgggtattcggatgggttgttatggtatgttcctataacgcacccgtcaaaatgtttagttgcctttgaagtggcggatgacgttgtgccatactcagtccgaagagagagaatcatttcaaggttccctctcagctctaaacatttaaggggtatcgcattaatcgcggtcaatcggaatcagaaagtgtcggtgcaaacagagggtatagttacgcatcgactttgtaaaaagaatttattaaaatatgtatgcgatgtggtcttgttcaaattctctggttacgtatttgggaacgatgaaatgttaacaaagttgctaaatgtataactctcgtgacagagagttcgcacgttatacacttac

SEQ ID NO: 126 - DNA, 1635 bp, artificial sequence
  VP5 DNA of BTV23 AJ586727
gttaaaaagtgtaccctgagcgaagatgggtaaggtcatacgatccctaagccgatttggcaaaaaagtaggtaacgcgttaacttcaaacactgcaaagaaaatctacagtacgattgggaaggcagctgaaagattcgctgaaagtgaaattggatcagcagctatagatggattagtgcagggtagtgtacactcgataataacgggtgaatcatatggtgaatcggttaaacaggctgtgctattaaacgtgctaggtagcggtgaagagattccagatcctctaagcccaggggagcggggtatccaggcaaaactcaaagagttggaggatgagcagcgaaacgaacttgttcgtttaaagtacaatgacgaaattaagaaaaaatttggagaagagttggaacaagtttacgatttcatgagtggggctgcaaaagaggaagctggagatgaaaaacaatttgatattctgaataaagcggttaattcatataataagatattagctgaagaagacttgcagatgcgacgacttgcaacggctttacagaaggaagtaggcgagagaacacgtgtagaaactactatggtgaaggagtatagggataagatcgatgctctacgaagcgcaattgaggttgagagggatggaatgcaggaggaagcaatacaagagatagctgggatgaccgccgatgtgttggaggcggcgtcggaagaagttcctctaataggagcggggatggcgacagcggttgcgactgggagagctatcgagggagcatacaagctcaaaaaagtgataaatgctctaagtgggattgatttgacacatctacggaccccgaagatagaaccaactgttgtatccactatattagaacatcgtacaagggatatcccggataatgcgttggcggtaagcgttctatcgaagaaccgtgtcatacaagaaaatcataaggaactcatgcatattaaggaagagatattgccacgttttaaaaaggcgatggacgaagagaaggaaatatgtggaatagaggataaggttatacacccgaaagttatgatgaaatttaagattccgagagcacagcaaccacatattcatatttatagcgcaccatgggactcagatgacgtgttcttctttcattgcgtttcacaccaccatatgaatgaatcatttttcttaggatttgatctgagcatcgatttggttcactatgaagatttgacagctcattggcacgcattgggcgcagcgcagatggcggtaggacgcacgctaactgaagcgtataaggagtttcttaacctggcgatctctaacgcctacggcacgcaaatgcatacgagacgtttgatcagatcgaagaccgtacacccaatctacctgggatcgcttcactatgatgtttcgttcgcggatttgcgagggaatgctcaacggattgtgtatgatgacgaactacagatgcatatactacgtgggccgctccattttcagagacgagcaatattgggtgcgttgaaattcggatgcaaaatacttggggatcggttggacgtaccactcttcttacgaaatgcttgaacgcagcgatggggagcacttacacttac

SEQ ID NO: 127 - DNA, 2924 bp, artificial sequence
  VP2 DNA of BTV24 AJ585145
gttaaaagagtgacccacgaatggaggagtttgtcattccagtttattcggagaacgaaattccatatacgctactgaatagatacttgcttgcgatacgaactgatgtcaagattaatgatgtggagaaaaagcacaatgtgatcaaaatacctgattctgacatgatagatataccaaaaatcagcatagtagacgcactcagttacagacctacaaggaacgatggtattgttgtgccaagattacttgatataacactacgtgcgtatgatgatcggaaggcaacgaagaatgcgaaaggggtagagtttatgactaatgccaagtggatgaagtgggcgattgatgacagaatggatattcaacctttgaaagtcacgttggatgaccactattctgtgaatcaccagctattcaattgtgtagtaaaagcaaagccagctaacgccgatacggtttactatgattattatccactagaaagtaagatgaagaaatgcaaccacacgaatttagacatgttacgtagtttaacgactatggagatgtatcatatattgcaaggagcggcttatggtttgaaatcgacttatgaattgaaagctcacgcggagcgggagaatacgggtgagagttatccgataggggaaaggttgttacaaatacccagaggaacgaagataggaagtagaggagaaccttataataaattcgtcgctggattggtaaaagtgactataaaaggtaaagttcctgctgaaatcggggaagagatgaatcaattaaatcgaatcaaagaggagtggaagagcgcatcgcacgacagaagcaggatacgtgctttagaactatgtaaaattctatcaacgattggccgaaaaatgctggatgcgaaggaagagccgaaggacgagatggatttatctacacgatttcaattcaaactagatgagaaatttaccaaaactgactcagaacatataaacatattcagagcaggtggacccgctacagatgacggtagattctacgctttaatcgcaatcgcggcaactgatacgcaaaaaggtagggtgtggaggatgaatccgtatccgtgtttacgcggcgcaataatagcggccgaatgcgaactaggtgatgtgtatttcacgctgcgtcaggtgtacagttggagtttgcggccagagtatggacagaaggaaaaaccattggaagtgaacaagtatgtatttaatcggattaatctgtttgattcggacctaacagtaggagatcagatcgtacattggcgctatgagttatatcccccggttgagacgacttatgatgatgggtatctatgtggatcagataaagaggacgatgagttattatgtgaagttgacgaggagaaatataagaagatgtttgaaaatatgatcgagggtggatgggaccaagagagatttaagcttcatagcattttaactgacccgaatctattaacgatagattttgaaaaggatgcgtatctcaattcaaggtcggagctggtatttcctgaatatttcgataagtggatcaattctcctatgttcaacgcgaagttacgactagcccatggagaaatcgcaacgcgcagagcaaacgacccatggaacaatcgggcggtgcatggatacataagaacatccactgaatcccttgggtatgctttgggtagctattatgatctaaggctacagttattcggtgacgcgttaagtttggaacaacgacagtcggcggtctttgaacacttgaataaacaggacgatttcttcacgctaaccggctacgcaaaagatcaagttgtatgccctcattccggcggtgcgttctatacgttccgcagggttgcgctggagatcttatcgaactatgagaagcttacgccggacttacatgaagggctggaacatcagacttacacgcacccgaagataaacgaatattttaatagatttgttctagatatgaaagacttttcgcaattgatatgttttgtattcgatcattttttcgaaagacacgagcagttacgagatgtggcggaagcgagaaggttggtctatttgatccaaaaatctgacgggcctgagcggttggacgtcctccagaggaactttcctaacttttttcgacgtttcatgaatttgaaggacgtcaaatatatatacgatttaaatgtggtcaactttttaccgcttcttttccttatccaagataacatatcatattggcatagacagtggtctgtcccagtgatactttatggcgatattattaggttaatcccggttgaagttggagcttatgcgaacagatttgggatgaagagcttctttaattttactcgatttcaccctggagattcaaagaagaagcagaacgcggatgatacacataaggagtttgggctgatatgctttgagtattacacaaaaactaagatttcacaaggtggggttgatatatccgtggtcacaacgaagatggacacgttaaaggtacacttagcgtcgctgtgttcgggaatcgcggattcgattgtttataccctaccagtcgcacatcccaagaaatgcgttgtattaatagtcattggggacgacaacgttgatatgcaaattcgatccgagcaggcgattagtcggtattattactctcgtagacatatcgcgggtgtcgtgtctatatgtatcagccaggatggtgggttaaaagcatactcaactggcatcgtcaagcatcgtatctgcgaaaaatcgatcctgaaatataagtgtaaagtcgttttagtaagaatgcccggctatgtatttggaaatgatgaattgatgacaaaactacttaacgtttaggtcccgcgacacggacctgtggcctcttacgcttac

SEQ ID NO: 128 - DNA, 1638 bp, artificial sequence
  VP5 DNA of BTV24 AJ586730
gttaaaaagtgttctcctactcgcagaagatggggaagataattaaatcgctaagtagatttggaaaaaaggttggaaatgcattgtcgtcaaacacagcgaagaaaatttattcaaccattgggaaagcagcagagcggtttgctgaaagcgagatcggtgcggcgacaatagatggtttggtgcagggtagcgttcattccataattacaggtgaatcttatggagagtcagttaaacaggcggttctcctcaacgtgttaggtacaggtgaagaattaccagacccactgagccctggcgagcgtggtatgcaaacaaaaataaaagaattagaagatgagcagcgaaatgaacttgtccgattaaagtataacaaagagataacaaaagagtttgggaaggagctagaagaagtttacgacttcatgaatggtgaggcgaaagaggaggaagtagttcaggaacaatactcaatgctatgcaaagcagtagattcatatgaaaaaatattaaaagcagaggactcgaaaatggcaatattggcgcgcgcgttgcagcgggaggcttcagagaggagtcaagatgaaatcaaaatggtgaaagaatacagacagaagatcgatgcgctaaaaaatgcgatcgagattgagcgagatggaatgcaggaggaggcgatccaggagattgccggaatgactgcggatgtcttagaagcagcatcggaggaggtgcccttaattggcgcgggtatggccacagccgtagcgaccggtagagcaatagagggcgcgtataagttgaagaaagtcataaatgcattaagcgggattgatttatcgcatatgaggagcccgaagattgagcccactattatcgctacgacattggaacatcgatttaaagagataccagatgaacagttggcagtaagtgtgctgaataaaaagacagctgtgaccgataactgtaatgaaattgcgcatatcaaacaagaaatattaccaaagtttaagcagattatggatgaagagagagagattgaaggaatagaggataaagtgattcatccgcgagtgatgatgaggttcaaaattcctagaacgcagcaaccgcaaattcacatttatgcggccccgtgggattctgatgacgtattcttctttcattgcgtttcacaccatcatcggaatgagtcttttttcctgggattcgatttgggaatcgatgtcgttcactttgaagatttgactagccattggcacgcgttgggattagcgcaagaggcgagcgggcgtacgttaacggaggcgtatcgcgaatttctcaatctatcaatctcaaatacgtatagtagcgctatacatgcgagacgtatgatcaggtcgcgggcagtacaccctatttttctaggatcgatgcattatgatatcacgtatgaagctctaaaaaataatgcgcagagaatagtttatgatgaggagttgcagatgcatattctgaggggacctttgcacttccagcgtcgagccattctaggggcgctgaaatttggagttaaaatattaggcgataaaattgatgttcccctcttcttacgaaatgcttgaacgcagcgagggagaagcttacactcac

SEQ ID NO: 129 - DNA, 2880 bp, artificial sequence
  VP2 DNA of BTV25 EU839840
atggatgagctagttataccaatattctcagcggatgaaatgccttatgcactaataagtcattatccgttagcaatacaaacaaacaggaagattcagaatgatcgtgaattccatgacctgacaaagattccccaatctaatatgatagatatttcacaacacggcgtgattagagctctagattatcgtccttcgaggaatgatgggatagtaataccaaggttgttggatataacactgcacgcgtatgataagagacggtcgatgaaggatatatgtggattagaatttaaaacggatgtgaaatggatgcaatgggctatcaatgatagaatggatatacagccattgaaagtcgagatcgataatgaacatacggtgaatcatcaattatttaattgtaatataaaaatcagatctaaaaatgtcgatacggtgtactacgattatcatccgcttgagagtgaggcgactaagtgtaatcatgcgaacatagagctaatgcggagcttaacgatggtggaattgtaccatgttttacaaggtgccgcttacgctttaaaaacgaattttgagctgattgcgacggcggagagaggagacgtacgacagagatatgacgcagcaggggtaagatggtccagactatcacgagatcaaaggatagggtacagcggcaacgcttacgatatgtttatggctaacctagtgcaagtggaggtaaaggggaagtgcgcagatgaaattgcgggtgagatgggacgacttgcgaaaatcaaagacaagtgggtgtcaaacgggttttctggcactgtaatattcgtgtcggagttatgtacagagttttcagcaatcggacgtaagatgatggatacacatgaagaaccgaaggatgaagagggtatttcacgacgctttcaaattgagttagatggcatgtttagtgcggcgcgtcaggagaataaaaacgtgctgagtcagagaggcagcaaggtaactgatgaatccaagttctatgctttaatcatgatagcggcgtcggacacacagcagggaagagtgtggagaacgaacctttacccttgtttgcgaggtgcgttggttgcagcagagtgtgtgatgggtgatgtatatcatacgctgcgtaccgttttcaactggagtgtgcggggtacgtatggcgggacagagcgaaatctagagaacaataggtatatcttctcccgcataaacctttttgaaaccaatttaccgagtggtagtaagattgttcactggtgttatgaagaagtagcgccaattgaaactacctatgataatggatatatatgtaaatcgcaagaaggagtacagaatgatgagaaattgtgtaaaattgatgatgatttgtatgcacgtatgcgcgatgaagcgataacgggtggatggcgacaggaagacttcaagttacataagatactgactaacccgaatttactcacgattgattttgaaaaggaagcttacattacgtcgacttcagatttaatcttgccggattattttgataagtggattaaagcgccaatatttaatgcacggctgcggataacgaatggagtgattgaaagtgaaaagaaaagcgacccgtggaataaacgtgtagcgaacggcacgatgaagacttcagctgaatcattgggatacgtgctgggtagattttatgatttacggatgcaatttgtcgaagatgtactaaacacccgacagcagaagtcattagctcttcaacacatacgtaatctagaagattttacgagattaacagattatggggaggaacaaaatatttgtcctcatgcgggcggcgcaatgtatacatttcgaagggtagctctagaaataataacaaattatgagagactgaacccaatggatcatgaaggtaatgagtatcaaacatatcgccatccagctattgattactcaaagcttggtgacgttcttaagatgaaagatttatctcaactcatctgttttgttttcgatagtatatttgagcggcgcgaccaattgcgtgaggttggagaggcgcgaatgatcatatatcaaatccagaacgcgactggggaacggcgacttgatgtgttaaaacgggagtttccaacgttctacgtatggttccataggttacgggatgttgagcttattcgtgatttaaacgttatcaattttcttccactactgtttttagtgcgagataatgctgcataccggcatagacagtggtcaattcccatgatactttatgacgaagaaattaaattaatacccgtagaggttggcgcatatgcaaatagattcgggtttaagagttttattaattttactcgattccatccaggcgatgcgcgtaagagacaggaagtgagtgcgtttcataaggcttatggttcgatttgttatcgctactataccgatacgacaatatcgcaaggtgaggtaaacgtaccggttatcactacaaagttggacacacttagagtgcatttagcagcattatgcggcggtttatcggactcgctcgtttataccctcccaataacacatccagagaagtgccttgtgttagttattgtcggagataataagttgaatccacagattcgatcagaactggtaattagcagataccgctattcacgtcgacacatacgtggtgttgtatctgtttgtattgaccaagagggactgcccaatgtttattccactggtatagcgagacataaaatatacgagaaaacggtgttaaggtatagatgtaagataattttggtaaagatatccggatacgtgtttggaaacgatgaacttatgactaagctgctcaatgtttag

SEQ ID NO: 130 - DNA, 1581 bp, artificial sequence
  VP5 DNA of BTV25 EU839842
atgggaaagatcattagatcgctaagtcgtttcggaaagaaggtgggaagtgcgctaacatcgaatacagcgaaaaagatttatgcgacaattggaagggcagcagaacgtttagccgagagtgagatcggatcggcgacaatagacggattattacagggtagcgtacactcgctcgtaactggagaatcatacggcgagtcagtgaaacaagcagtattattaaacgtattaggtactggagaggagttgccggaccctctaagtccaggagagcgtggattgcaagttaagctaaaggagctggaagatgagcagagaaatgacctagttcggttaagatatggcgaacagattagagccaagtttggggccgagctggatgagatctatcaatttatgactagcgcgatcagaaatgatggagaagcgaaggaagagtatgagatactaaataaggctatcaactcatatgagaagatactcaaggcagaggagacgcaaatctcaaccctagcacgcgcactacagcgtgaggcatctgaaagaagcgaaaatgagattacgatggtgaaggagtataggcaaaaaatcgatgctttaagggatgcaatagaagttgaacgtgatggtatgcaggaggaagcgattcaggaaattgcagggatgacagcggatgttcttgaggcgacatcagaagaagtgcccttggttggggcgggcgtggcggcgacaatcgcgacgggacgtgcaatcgagggcgcttacaaattaaaaaaggtaattagcgcgttaagtggcatcgatttgtctcatatgcgcaccccaagggttgaaccgacaacccttgcaactacgttagatcggcggttcggcgagatatcggacaaagacctagcgataggtgtgctgaacaagaggacgtcggttcttgacaattatagtgaaatagcacatataaaacaggaaataatgccgaggttcaagcgaattctagatgaagaaaggaagattgagggtgctaataaaaagtatatacatccaagggttatgatgaaatttaagattccaaggacgcagcagccgcatattcatatatattctgctccgtgggattctgatgatgttttctttttccattgcgtttcacatcatcaccgaaacgagtcattctttcttggctttgatttgggaattgatgttgttcattttgaagatttggcgagccattggcatgctctaggttcagcgcaggaggcgagtggtcggaccctgactgaggcgtacaaagagttcttaaatttatccatttcaagtgcgtttagttcaccaatacatgcaaagcgcatgattagatcacgaaccgtacaccccatctatttgggttctatgcattatgatgtaacgtatgaagtattgaaaaataacgcccagagaattgtatacgatgatgagctgcagatgcacatactacggggaccactgcacttccaaagacgcgcaatcctgggggcactaaagtttggcgttaagatattaggcgagaaaatcgatatttccctcttcttacgaaatgcctga

SEQ ID NO: 131 - DNA, 2929 bp, artificial sequence
  VP2 DNA of BTV26 HM590642
gttaaaagagcgttccaccatggaggaatttgtcattcccatatattcgagtagagacatgccattagcgctgatcagtcaatatccactcgcggtgcaagtagacgcgattatggcggatataggggatgatcataatttagctttaattccagagttaaacatgattgatatctctaagcaagggattatcgatgcgttggattaccgaccagcaagaaacgatggagtggtggtaccaaggttactggatattacgttacacgcatatgactgcaaaaggtcgatgaggacagcacggaatactgaattcgcgacggatactgaatggatgaagtgggcgatagaggatagaatggacgtgcaaccactaaaaattttaattgacgaccattattttattaaccaccaattgtttaattgtaacgttaaggcaaaatttggtaatgttgatacaatctattatgatttgcacccgctcgaaaagaaggaaaagaaatgtaatcatatgaacatagagctaatgcggagtttgactatgactgaaatgttccatgttctgcaaggagccgcatataccctaaagacgaactatacattgacggcracagccgaaagacaagacatatcccatagctttgaaaacgtaggtttgagatggcaaaatctggcgccgaatacgcggattgaaaatagaggatctgcatacgacaaatttattgccgggttggtgcaagtaaggattgacggaaagtgcccaaatgaaatcacggcagaactgaaccagctacggagtgtaaaagagaaatgggttggggcgcaatatcaaggcaacgcaatatacgctcatgaaatatgtagtgtgatgtccgcaattggccgcaagatgctaaatgcacgtgaggagccagttgatgaagaaggtatctctagacgttttcagcaggagatagacgacgtattcagccagatgaatcgggaaaacgttgccgtgcgcagagtcgctgtccacgcaaacgacgaacagaaattttttgccctgatggttatcgcggctactgacgtaaaccaggggagaatctggaggacgaacccatatccgtgcttgcgaggtacgttaattgcggcggaatgcgcgttgggtgatgtgtattcagcaatgcgtagaatcttcagctggagcgtacgcccaacctatggaacgggtgaaaagcagttggaaaacaacagatacgtgtacagtcgcataaacctttttgagtcgaatatctcagttgatgaggaagttattcattggcgctatgaattattggctcctgccgagaccacatacgataggggttacatatgctcggtagaacggggagatgacgatttattgtgtaagatcgacgatgccgcctataaattgatgtttgatgaagcagtgcgagtggggtggcagcaacacacgtttaagctctataagatgctaactgagccgaatttacttacaatagacttcgaaaaagacgcttatttaggaccggattcaagcttagtgatgccggattattataataagtggataaggagtccaatgtttaacgcacgactacgattgacgaaggcgcgaattaatgcagagaagacgggcgatccgtggaacgatcgagtggtgggtgggactattaagactccagttgagtcgttaggatacacgctgggaagattctatgacttacgcttacagttcgtcgaagatgttttgagttataggcagcagcaatctgcaatttttcagtacatgggtgcacgagaggacttcgctatgctaacacattacgctagaggtgaaagggatatatgcccgcatgcggggggaactctatatataacgcgccgagtggcgctagaggtgttaacaagttatgaaagacttgatccacaatatcaccacggtcgtgagcatttaacttactgtcatccatccattgattatacgcgtcgggagcgcattttcgagatagaagacctggcgcagttgatttgctatgtaatagattatatttttgaaaaacgagattcattacgtgaggttggagaagcgagaagaatcgtatatctgattcagagcgttactgggatacgtcgacatgaagtacttaaccaggcgtttccgagattcttcgcatggtttctcagactaaaaaacgtcgaggtgattcgtgatctgaacatcgtgaacttcttgcctctattatttttggttcgcgataacatatcatatcaacatcgacagtggtcggttccgatgatcctttatgatcaaacgattaagttaatacctgtagaggttggtgcgtatgcgaatagagtaggctttaaaagttttttcaacttcgttcagttccatcccggcgacgcacaaaaacggcaggaggcggatgaatcacataagaaaatgggccagatctgttacgcatactatactgatactacgatttcacagggcaaagtagatacgcccgtgattgcaactaagatggacacgttacgggtgcatctggcagcagtgtgcgcaggtctgtcagattcgcttgtttacgcgctgccagttgcgcatcccgagagatgtattgttttaataattataggggatgaaaaactcgatccaaatgtccgcaccgaattagtagttagtagataccgttattcacgtaaacacatacgaggcgcggtctcaatatgcatgtataagaatggtcagtttagggtgcatacgactggcatagtaagacaccggatttgcgaaaaaacgatacttaacttcagatgccgtgcgatattagtgaggacaccgggatatgtctttggaaacgatgaattgatgacaaagttgctcaacgtgtaggtcctttgacacggaccggtggcctcttacacttac

SEQ ID NO: 132 - DNA, 1629 bp, artificial sequence
  VP5 DNA of BTV26 JN255159
gttaaaaagtaccctctaactcgcagaagatggggaaaatcataaagtcgctgagtaggttcggcaaaaagattgggagtgcactgacatcaaatgcggcaaagaaaatttacgccaccgttgggaaagcggcggaacgcctcgcgactagtgagttggggacagcagcgattgatgggctattgcaaggcagtgtacattcaatgataacgggggaatcttacggcgagtcagtgaaacaggctgttttactgaacgtattaggtactggggaggagctaccagacccattgagtccgggagaacggggaatgcagatgaaaattcaagagctcgaagatgagcagcgtagtgaattgatccgattgaaatatgatgatgaaattacacgcgcgttcggcaatgagctacgggaggtttatcaattcatgaatggtcaagttcgtgcggatctggatcaatatgatgtgctacgcaaggcagtagattcgtacgaaaaacttctagacgcagaagatgcgaagatggcgatattagcacgtgcattacaaaaagaaatgcgggaaaggagtgccgaggaagcaaagatggttcgagagtataggagtaaaatagatgcacttaaagaagcaattgaggttgaacgtgatgggatgcaagaagaggcgattcaggaaattgcggggatgactgcggatgttttggaggcaacggcagaggaagtcccacttataggcgcaggcgcggctgcagcgatcgcttcagggcgagcaatcgagggggcgtataagttgaagaaagtgataaatgcacttagcggtattgacttatcacatatgcgtacgccgaaaatagagcctaccgttatctctacggtacttgaacatcgttttaagagtatacccgataacctattggcgaatggcgttttaagcaagaagatttcgattatggataaccaaaacgaaataaggcacataaagcgagaaatattgcctaggtttaagcgcattatggatgaggaaagagcagcggctaacagggaacataaagtaattcatccaacggtaatgatgaaattcaaggtaccaagggcgcaacagccccagatacatatatatgcggcgccgtgggattcggatgaagtgttctttttccattgtgtctcacatcaccatcgtaatgaatctttcttcttgggattcgacctgggaattgatattgttcattttgaagatctgacgaatcattggcacgccctaggagttgcgcaagaagctaaaggccgcaccttaggtgaagcgtataaagaatttctgaatctcccaatatcaagctcttttagttcaaggatacatgctcgacgtatggtcagatcacggttagtccacccaattttcttaggatcgatgcattacgatgtgacctacgaaacgttgaaaaacaacgcgcagagaatagtatatgatgaggagctgcaaatgcatatattgcgtggacctctacacttccaacgtcgcgcaatattaggagcgctgaagtttggggtgaagatactaggcgacaaaattgatatccccctcttcttaagaaatgcctgagcgcagcgggggaggtgcttacacttac

SEQ ID NO: 133 - protein, 961 aa, artificial sequence; identical to SEQ ID NO: 2
  VP2 of BTV1 sBTV ACR58459.1

SEQ ID NO: 134 - protein, 526 aa, artificial sequence; identical to SEQ ID NO: 5
  VP5 of BTV1 sBTV ACR58462.1

SEQ ID NO: 135 - protein, 962 aa, artificial sequence; identical to SEQ ID NO: 13
  VP2 of BTV2 sBTV AEO19855.1

SEQ ID NO: 136 - protein, 526 aa, artificial sequence; identical to SEQ ID NO: 14
  VP5 of BTV2 sBTV AEO19851.1

SEQ ID NO: 137 - protein, 962 aa, artificial sequence
  VP2 of BTV2 sBTV CAE51089.1
MDELGIPIYGRNYPEHLLKGYEFLINTGVKYPSQGGRHDVSKIPEMFAYDIKDEGIRDALKYMPTRNDGVVLPRIVDISLKGYDIRKSVIEANKSNSFHTDTNWVQWMIKDSMDQQPLKISIDEEHSRVVHSLFNCQVKIDAKKADTLSYHLEAIEDAEKACLHTRGQLCNHLTRMDLLHAAQEIAYAIKPTYQLIVHSERASTSDNFELGRQDVITLRRGHRVQMGDEAYTKLMERLVRLTVQGNVPRKIQSEIEQLEAIRTRWATGRYDPAHINSQDLCRILSRIGRIMLDQEAEPVDEDSLSLRFQRALDEKFRLNDSERNKIFEHKSHRKDEDRFYVLLAIAASDTYNSRIWWSNPYPCLRGTLIAAETKLGDVYFTLRSWYDWSVRSSYIPRERERETEKYIFSKINLFDYEAGPSSKVIHWEYQLYKRERVVTLERGNPCDLYPDEDDEVIITKFDDAKYSEMVGEIIDGGWNDEEFKMYKLLQEKGNVLTIDFEKDTKLNNTSEVVLPDYYGKWIVAPMFNSKMRIIETEIATNKSDDPMIKRTLKPMTDDPVELQRYTLARYYDIRPGLMGRSLNRTQTQSTFDPKVKKLPDYKKVVSRFGVIKKPTRPCVTLTGRYILEKYSLLLIDILKYHTEVEGNPQEEFTHPRIDPQFKFNGNTLSDLNQTVVFIVDYLHEKRNYVRSIYEARYIISRIRSSTGAARMSIIEFYFPTFARLISNAREPTYVKDLMALNFLPLLFIVGDNMIYKHRQWSIPLLLYTDRVKVIPLEVGSSNNRQGFVSYLEYMFFFPSLADRTSKVDESMIKVSKEMVNYYMKTTISEGAVNLNVVSTKSLLYEIYLSSVCGGVSDGVVWYLPITHPYKCVVAIEVCDDRVPARLRCDRLKLRFPLSAQHLKGIVVIQINEEGGFDVYTEGIVTHRVCKKSLLKHVCDIVLLKFHGHVFGNDEMLTKLLNV

SEQ ID NO: 138 - protein, 526 aa, artificial sequence; identical to SEQ ID NO: 14
  VP5 of BTV2 AEO19851.1

SEQ ID NO: 139 - protein, 959 aa, artificial sequence; identical to SEQ ID NO: 16
  VP2 of BTV3 CAE51090.1

SEQ ID NO: 140 - protein, 526 aa, artificial sequence; identical to SEQ ID NO: 17
  VP5 of BTV3 CAE53013.1

SEQ ID NO: 141 - protein, 956 aa, artificial sequence; identical to SEQ ID NO: 18
  VP2 of BTV4 ABB71699.1

SEQ ID NO: 142 - protein, 526 aa, artificial sequence; identical to SEQ ID NO: 19
  VP5 of BTV 4 CAE53015.1

SEQ ID NO: 143 - protein, 956 aa, artificial sequence
  VP2 of BTV4  CAE51091.1
MEEFVIPVFSEREIPYALINRYPLAIQTDVKIVDVDGYHNLAKIPESDMVDVPKLDIVSALNYKPTRNDGIVVPRLLDITLKAYDDRKSVKNARGVDFMTDAKWMKWAIDDRMDIQPLKITLDEHYAVNHQLFNCIVKAKTANADTIYYDYFPLEDRAKKCNHTNLELLRSLTTIEAFHVLQGAAYSLKSNYDLIANSERESLEESYPIGSEKWVHLTRRAKIGNSGLSYNRFISSMVQVVVRGKVPDIIRGEITQLNRIRTEWINASYDRTRIRALELCNILSAIGRKMMDAHEEPKDEMDLSTRFQFKLDEKFNTSDSEHVNIFRTSGAATNEGRFYALIAIAATDTQKGRVWRTNPYPCLRGALIASECELGDVYYTLRHVYRWSLRPEYGQRERQLEDNKYVFGRVNLFDSDLAVGDQVIHWRYEITEPVKTTYDNGYICNPEEKDDELLCKIDDERYKEMMERLIEGGWDQERFKLHNILTEPNLLTIDFEKDAYLNSRSELVFPNYFDKWINSPMFNARLRITHGEIGSSKTADPWNRRVVYGYIKTSIESLDYTLGKYYDIRLQLFGDTLSRKQTQSAVFTYLSGQDDFPTLTNYLKSEAVCPHAGGAVYTFRKMALSLIANYEKLNPEMHEGLEHQTYVHPSVNTTYQKQVKDMKDFSQLICFIIDCIFEKRIQIRGVGEARRIIYLIQNSIGLQRQEVLKRTFPNFLMRLFKLREVKRICDLSVINFLPLLFLVQDNISYWHRQWSVPMILFDDAVRLIPVEVGAYANRFGFKSFYNFIRFHPGDSKKKQDADDMHKEYGVACFEYYMNTKISQGGVNVPVVTSKLDTLKIHLASLCLGLADSIVYTLPVAHPKKCIVLIVVGDDKLDPQVRSEQVLSKYYYSRRHICGVVAVSVGQEGQLQVYSSGIVRHRICEKSILKYKCKVVLVRMPGHVFGNDELMTKLLNV

SEQ ID NO: 144 - protein, 526 aa, artificial sequence; identical to SEQ ID NO: 19
  VP5 of BTV4 CAE53015.1

SEQ ID NO: 145 - protein, 955 aa, artificial sequence; identical to SEQ ID NO: 20
  VP2 of BTV 5 CAE51092.1

SEQ ID NO: 146 - protein, 526 aa, artificial sequence; identical to SEQ ID NO: 21
  VP5 of BTV5 CAE53016.1

SEQ ID NO: 147 - protein, 955 aa, artificial sequence; identical to SEQ ID NO: 22
  VP2 of BTV6 CAE51093.1

SEQ ID NO: 148 - protein, 526 aa, artificial sequence; identical to SEQ ID NO: 23
  VP5 of BTV6 CAE53019.1

SEQ ID NO: 149 - protein, 959 aa, artificial sequence; identical to SEQ ID NO: 24
  VP2 of BTV7 CAE51094.1

SEQ ID NO: 150 - protein, 526 aa, artificial sequence; identical to SEQ ID NO: 25
  VP5 of BTV7  CAE53020.1

SEQ ID NO: 151 - protein, 961 aa, artificial sequence; identical to SEQ ID NO: 11
  VP2 of BTV8 CAM57243.2

SEQ ID NO: 152 - protein, 526 aa, artificial sequence; identical to SEQ ID NO: 12
  VP5 of BTV8 CAM57247.2

SEQ ID NO: 153 - protein, 955 aa, artificial sequence; identical to SEQ ID NO: 28
  VP2 of BTV9 AEO19807.1

SEQ ID NO: 154 - protein, 526 aa, artificial sequence; identical to SEQ ID NO: 27
  VP5 of BTV9 CAE53024.1

SEQ ID NO: 155 - protein, 955 aa, artificial sequence
  VP2 of BTV9 CAE51096.1
MDEFGIPLYRSTHVPHHVLEDYELRIDLSDRVVHGGDRHDPKKLKERKAIDVPDGDVRLDLNYNPTDNEGNQIPGALDIALCARITRKSVKTNEGVTFTTNHKWMEWMLLDAMDVQPLKIDFAALGGAVKCDLFNSAIYVKKKHADAIMYRYIAVEDESRGCNHSRVQDVNHLINNGLYNVAQECAYAFKDTYVLRVHSQRENVEEPFEIGRPKVGSLGRNAVISMENPGYPLFRAGLLQITVSGTIPADINDEMNRLNQIRSAWIRDKATREVKAIELCTLLSRIGRLKMDMEEEPKDEGAMSLRFQGKIDTMFFSENTEKTNIMRNISGRTDEERFYVLLLICATDAYTRRIWRSNPYPCLRGTLIATECVLGDAYKTLRQKFDWSVRHAADKAIENFSHIFTRINLFDTGKTPGARIIHWVQEMTMGTKTSWESGYPLKDEAPDDELHCRVDRDQHRQMVTRIIDGGWDHENFKIHKLFHEQGNIFLMDFEKDARLTSRSEVEYPYYYDRWIYASIFDTRYKIMETEIATAKNADPAIKRTLAPLMDDPVMLQLRTIGNLYDTRPAIMGSTLSARQAQTSLHKTLLDEAENGRYYRSRGLEKRANPCSVCYTSSFVLQKVSELVLSLMIYHVDHDWEPLKQYNHPDVLSEFSETVREIHDISQLIVLLVDLFFEQRRTVRPVEEARYVIYSIRVARGADRLDTFRRFFPAFGRALDVVNRATDVAHITALNFLPFFFLLGDNIIYKHREWTVPVLIYTEGVMIWPAQVGANFNRFGFCGFLNYMRFHAGSRLRAKPLDDAEKIVTREMLRYYMKTDIFDGGVQKNIRVTKSSQMEIYHSSLCGGLSDAVVYVLPISFPIKCLTLIIVGDDLVEPQMRFGRVMDFFRHVAEHVRGVASISISRNGDITTHSQGIVRVELLKKNILKYQFQVALLKVKGFVFGNDEILIKLLNV

SEQ ID NO: 156 - protein, 526 aa, artificial sequence; identical to SEQ ID NO: 27
  VP5 of BTV9 CAE53024.1

SEQ ID NO: 157 - protein, 956 aa, artificial sequence; identical to SEQ ID NO: 29
  VP2 of BTV10  CAE51097.1

SEQ ID NO: 158 - protein, 526 aa, artificial sequence; identical to SEQ ID NO: 30
  VP5 of BTV10 CAE53025.1

SEQ ID NO: 159 - protein, 956 aa, artificial sequence; identical to SEQ ID NO: 31
  VP2 of BTV11 CAE51098.1

SEQ ID NO: 160 - protein, 526 aa, artificial sequence; identical to SEQ ID NO: 32
  VP5 of BTV11 CAE53026.1

SEQ ID NO: 161 - protein, 950 aa, artificial sequence; identical to SEQ ID NO: 33
  VP2 of BTV12 CAE51099.1

SEQ ID NO: 162 - protein, 529 aa, artificial sequence; identical to SEQ ID NO: 34
  VP5 of BTV12 CAE53027.1

SEQ ID NO: 163 - protein, 959 aa, artificial sequence; identical to SEQ ID NO: 35
  VP2 of BTV13 CAE51100.1

SEQ ID NO: 164 - protein, 526 aa, artificial sequence; identical to SEQ ID NO: 36
  VP5 of BTV13 CAE53029.1

SEQ ID NO: 165 - protein, 955 aa, artificial sequence; identical to SEQ ID NO: 37
  VP2 of BTV14 CAE51101.1

SEQ ID NO: 166 - protein, 526 aa, artificial sequence; identical to SEQ ID NO: 38
  VP5 of BTV14 CAE53030.1

SEQ ID NO: 167 - protein, 952 aa, artificial sequence; identical to SEQ ID NO: 39
  VP2 of BTV14   CAE51102.1

SEQ ID NO: 168 - protein, 527 aa, artificial sequence; identical to SEQ ID NO: 40
  VP5 of BTV15 CAE53032.1

SEQ ID NO: 169 - protein, 959 aa, artificial sequence; identical to SEQ ID NO: 41
  VP2 of BTV16 CAE51103.1

SEQ ID NO: 170 - protein, 526 aa, artificial sequence; identical to SEQ ID NO: 42
  VP5 of BTV16 CAE53035.1

SEQ ID NO: 171 - protein, 955 aa, artificial sequence; identical to SEQ ID NO: 43
  VP2 of BTV17 CAE51104.1

SEQ ID NO: 172 - protein, 526 aa, artificial sequence; identical to SEQ ID NO: 44
  VP5 of BTV17 CAE53036.1

SEQ ID NO: 173 - protein, 957 aa, artificial sequence; identical to SEQ ID NO: 45
  VP2 of BTV18 CAE51105.1

SEQ ID NO: 174 - protein, 526 aa, artificial sequence; identical to SEQ ID NO: 12
  VP5 of BTV18 CAE53037.1

SEQ ID NO: 175 - protein, 962 aa, artificial sequence; identical to SEQ ID NO: 47
  VP2 of BTV19 CAE51106.1

SEQ ID NO: 176 - protein, 526 aa, artificial sequence; identical to SEQ ID NO: 48
  VP5 of BTV19 CAE53038.1

SEQ ID NO: 177 - protein, 956 aa, artificial sequence; identical to SEQ ID NO: 49
  VP2 of BTV20 CAE51107.1

SEQ ID NO: 178 - protein, 526 aa, artificial sequence; identical to SEQ ID NO: 50
  VP5 of BTV20 CAE53039.1

SEQ ID NO: 179 - protein, 955 aa, artificial sequence; identical to SEQ ID NO: 51
  VP2 of BTV21 CAE51108.1

SEQ ID NO: 180 - protein, 526 aa, artificial sequence; identical to SEQ ID NO: 52
  VP5 of BTV21 CAE53040.1

SEQ ID NO: 181 - protein, 951 aa, artificial sequence; identical to SEQ ID NO: 53
  VP2 of BTV22 CAE51109.1

SEQ ID NO: 182 - protein, 529 aa, artificial sequence; identical to SEQ ID NO: 54
  VP5 of BTV22 CAE53041.1

SEQ ID NO: 183 - protein, 957 aa, artificial sequence; identical to SEQ ID NO: 55
  VP2 of BTV23 CAE51110.1

SEQ ID NO: 184 - protein, 526 aa, artificial sequence; identical to SEQ ID NO: 56
  VP5 of BTV23 CAE53043.1

SEQ ID NO: 185 - protein, 955 aa, artificial sequence; identical to SEQ ID NO: 57
  VP2 of BTV24 CAE51111.1

SEQ ID NO: 186 - protein, 526 aa, artificial sequence; identical to SEQ ID NO: 58
  VP5 of BTV24 CAE53046.1

SEQ ID NO: 187 - protein, 959 aa, artificial sequence; identical to SEQ ID NO: 59
  VP2 of BTV25 ACJ06702.1

SEQ ID NO: 188 - protein, 526 aa, artificial sequence; identical to SEQ ID NO: 60
  VP5 of BTV25 ACJ06704.1

SEQ ID NO: 189 - protein, 957 aa, artificial sequence; identical to SEQ ID NO: 61
  VP2 of BTV26 AED99447.1

SEQ ID NO: 190 - protein, 523 aa, artificial sequence; identical to SEQ ID NO: 62
  VP5 of BTV26 AER60536.1

SEQ ID NO: 191 - DNA, 17 bp, artificial sequence
  VP2 of BTV1 5' UTR region
gttaaaatagtagcgcg

SEQ ID NO: 192 - DNA, 37 bp, artificial sequence
  VP2 BTV1 3' UTR region
tctgcttgaccgcagatccgcgcactattagacttac

SEQ ID NO: 193 - DNA, 25 bp, artificial sequence
  VP5 BTV1 5' UTR region
gttaaaaagtgcgcccttagcgaag

SEQ ID NO: 194 - DNA, 29 bp, artificial sequence
  VP5 of BTV1 3' UTR region
acgcagcgacgggaagcacttacacttac

What we claim is:

1. An immunogenic or vaccine composition comprising a recombinant Bluetongue Virus (BTV) vector comprising a vector backbone derived from a BTV-1 genome and a polynucleotide encoding a BTV-8 VP2 polypeptide and not a polynucleotide encoding a BTV-8 VP5 polypeptide.

2. A recombinant BTV vector comprising a vector backbone derived from a BTV-1 genome and a polynucleotide encoding a BTV-8 VP2 polypeptide and not a polynucleotide encoding a BTV-8 VP5 polypeptide.

3. A method of producing a recombinant BTV vector comprising transfecting a cell with RNAs encoding VP2 of BTV-8 and not a polynucleotide encoding a BTV-8 VP5 polypeptide; and RNAs encoding VP1, VP3, VP4, VP7, NS1, NS2, VP6NS4, and NS3/3A of BTV-1.

4. A method of vaccinating an animal comprising:
administering to the animal the immunogenic or vaccine composition according to claim 1.

5. The method of claim 4, wherein the immunogenic or vaccine composition is administered as part of a prime-boost regimen.

6. A method for inducing an immunogenic or protective response in an animal against one or more pathogens comprising:
administering to the animal the immunogenic or vaccine composition according to claim 1.

7. The method of claim 6, wherein the animal is a bovine, ovine, caprine, or equine.

* * * * *